US011602550B2

(12) United States Patent
Holzapfel et al.

(10) Patent No.: US 11,602,550 B2
(45) Date of Patent: Mar. 14, 2023

(54) COMPOSITIONS COMPRISING BACTERIAL STRAINS AND USE THEREOF IN CONTROLLING PATHOGENIC MICROORGANISMS

(71) Applicant: Better Air International Limited, Central (HK)

(72) Inventors: Wilhelm H. Holzapfel, Gyung-buk (KR); Yosep Ji, Gyung-buk (KR); Yuli Horesh, Tel-Aviv (IL); Michael Hoffman, Moshav Udim (IL); Shimrit Laor, Netanya (IL)

(73) Assignee: Better Air International Limited, Central (HK)

( * ) Notice: Subject to any disclaimer, the term of this patent is extended or adjusted under 35 U.S.C. 154(b) by 83 days.

(21) Appl. No.: 17/019,596

(22) Filed: Sep. 14, 2020

(65) Prior Publication Data

US 2020/0405781 A1   Dec. 31, 2020

Related U.S. Application Data

(63) Continuation of application No. PCT/IB2019/052016, filed on Mar. 12, 2019.
(Continued)

(51) Int. Cl.
*A61K 35/742*  (2015.01)
*A61P 31/04*  (2006.01)
(Continued)

(52) U.S. Cl.
CPC .......... *A61K 35/742* (2013.01); *A61P 31/04* (2018.01); *A61P 31/10* (2018.01); *C12N 1/205* (2021.05);
(Continued)

(58) Field of Classification Search
CPC ....... C12N 1/205; A61K 35/742; A61P 31/04; A61P 31/10; C12R 2001/125; C12R 2001/07
See application file for complete search history.

(56) References Cited

U.S. PATENT DOCUMENTS

| 2,293,722 A | 8/1942 | Erickson |
| D221,836 S | 9/1971 | Giles et al. |
| (Continued) | | |

FOREIGN PATENT DOCUMENTS

| CN | 1177636 | 4/1998 |
| CN | 1642827 | 7/2005 |
| (Continued) | | |

OTHER PUBLICATIONS

Notice of Allowance dated Mar. 4, 2022 From the US Patent and Trademark Office Re. U.S. Appl. No. 17/019,280. (7 Pages).
(Continued)

*Primary Examiner* — Jana A Hines

(57) ABSTRACT

A composition comprising at least two bacterial strains selected from the group consisting of *Bacillus subtilis* 281, *Bacillus subtilis* 3, *Bacillus amyloliquefaciens* 298 and a functional homolog of any of the preceding, wherein the composition does not comprise more than 5 different species of microbes, wherein:
  a sample of *Bacillus subtilis* 281, has been deposited as KCTC 13468BP at the Korean Collection for Type Cultures;
  a sample of *Bacillus subtilis* 3, has been deposited as KCTC 13467BP at the Korean Collection for Type Cultures; and
  a sample of *Bacillus amyloliquefaciens* 298, has been deposited as KCTC 13469BP at the Korean Collection
(Continued)

for Type Cultures. Also provided are methods that utilize the bacterial strains or functional homologs of same.

4 Claims, 12 Drawing Sheets

Specification includes a Sequence Listing.

Related U.S. Application Data

(60) Provisional application No. 62/641,443, filed on Mar. 12, 2018, provisional application No. 62/641,444, filed on Mar. 12, 2018, provisional application No. 62/641,445, filed on Mar. 12, 2018, provisional application No. 62/641,464, filed on Mar. 12, 2018.

(51) Int. Cl.
*A61P 31/10* (2006.01)
*C12N 1/20* (2006.01)
*C12R 1/07* (2006.01)
*C12R 1/125* (2006.01)

(52) U.S. Cl.
CPC .... *C12R 2001/07* (2021.05); *C12R 2001/125* (2021.05)

(56) References Cited

U.S. PATENT DOCUMENTS

| | | |
|---|---|---|
| D239,922 S | 5/1976 | Utley |
| D250,394 S | 11/1978 | Menius |
| D279,452 S | 7/1985 | Beechuk |
| D284,362 S | 6/1986 | Biesecker |
| D309,711 S | 8/1990 | Biesecker |
| D376,760 S | 12/1996 | Sykes |
| D433,336 S | 11/2000 | Weber |
| 6,405,944 B1 | 6/2002 | Benahkhoudja |
| D472,471 S | 4/2003 | McClure et al. |
| D473,143 S | 4/2003 | McClure et al. |
| D489,992 S | 5/2004 | Brauner et al. |
| D571,662 S | 6/2008 | Clark et al. |
| 7,858,336 B1 | 12/2010 | Garner et al. |
| D630,946 S | 1/2011 | Crawford |
| D656,599 S | 3/2012 | Browder |
| D663,215 S | 7/2012 | Clay et al. |
| D667,101 S | 9/2012 | Browder |
| D673,253 S | 12/2012 | Mack |
| D678,496 S | 3/2013 | Browder |
| 8,986,610 B2 | 3/2015 | Ben Haim |
| 9,486,552 B1 | 11/2016 | Ansley et al. |
| D805,909 S | 12/2017 | Matsuishi |
| D875,532 S | 2/2020 | Lehanneur |
| D879,613 S | 3/2020 | Lehanneur |
| 2003/0189066 A1 | 10/2003 | Schiller |
| 2005/0160553 A1 | 7/2005 | Gregory |
| 2005/0252930 A1 | 11/2005 | Contadini et al. |
| 2007/0217945 A1 | 9/2007 | Selander |
| 2009/0238716 A1 | 9/2009 | Weening |
| 2009/0324815 A1 | 12/2009 | Nielsen et al. |
| 2010/0021576 A1 | 1/2010 | Chang et al. |
| 2011/0214245 A1 | 9/2011 | Bassett |
| 2012/0152882 A1 | 6/2012 | Tune |
| 2012/0168971 A1 | 7/2012 | Hansen et al. |
| 2013/0015956 A1 | 1/2013 | Wegelin et al. |
| 2013/0068783 A1 | 3/2013 | Gasper et al. |
| 2014/0263426 A1 | 9/2014 | Gasper |
| 2016/0101925 A1 | 4/2016 | Franz et al. |
| 2016/0183538 A1* | 6/2016 | Taghavi. et al. ......... C05G 5/27 424/93.46 |
| 2017/0035262 A1 | 2/2017 | Li et al. |
| 2017/0035925 A1 | 2/2017 | Sevy |
| 2017/0348364 A1 | 12/2017 | Garner et al. |
| 2020/0407807 A1 | 12/2020 | Holzapfel et al. |
| 2020/0407808 A1 | 12/2020 | Holzapfel et al. |
| 2020/0407809 A1 | 12/2020 | Holzapfel et al. |
| 2021/0046256 A1 | 2/2021 | Hoffman et al. |
| 2021/0046497 A1 | 2/2021 | Hoffman et al. |
| 2021/0204774 A1 | 7/2021 | Dery et al. |

FOREIGN PATENT DOCUMENTS

| | | | |
|---|---|---|---|
| CN | 1934241 | 3/2007 | |
| CN | 103589655 | 2/2014 | |
| CN | 103703121 | 4/2014 | |
| CN | 104487566 | 4/2015 | |
| CN | 104688895 | 6/2015 | |
| CN | 104736162 | 6/2015 | |
| CN | 204501790 | 7/2015 | |
| CN | 303340433 S | 8/2015 | |
| CN | 105087423 | 11/2015 | |
| CN | 105219669 | 1/2016 | |
| CN | 205032305 | 2/2016 | |
| CN | 107567493 | * 1/2018 | .......... A61K 35/742 |
| CN | 107723267 | 2/2018 | |
| KR | 20-2009-0007893 | 8/2009 | |
| KR | 10-2014-0128870 | 11/2014 | |
| KR | 10-2017-0130341 | 11/2017 | |
| WO | WO 01/34182 | 5/2001 | |
| WO | WO 2016/060934 | 4/2016 | |
| WO | WO 2016/118864 | 7/2016 | |
| WO | WO 2019/175774 | 9/2019 | |
| WO | WO 2019/175775 | 9/2019 | |
| WO | WO 2019/175777 | 9/2019 | |
| WO | WO 2019/175777 A8 | 9/2019 | |
| WO | WO 2019/175780 | 9/2019 | |
| WO | WO 2019/175782 | 9/2019 | |
| WO | WO 2019/175782 A8 | 9/2019 | |
| WO | WO 2019/175783 | 9/2019 | |
| WO | WO 2019/224691 | 11/2019 | |
| WO | WO 2019/175783 A8 | 10/2020 | |

OTHER PUBLICATIONS

Notice of Allowance dated Mar. 9, 2022 together with Interview SUmmary Dated Feb. 16, 2022 from US Patent and Trademark Office Re. U.S. Appl. No. 16/645,509. (6 pages).
International Preliminary Report on Patentability dated Dec. 3, 2020 From the International Bureau of WIPO Re. Application No. PCT/IB2019/054141. (9 Pages).
Notice of Allowability dated Apr. 20, 2022 from US Patent and Trademark Office Re. U.S. Appl. No. 17/019,568. (4 pages).
Notice of Allowance dated Feb. 16, 2022 From the US Patent and Trademark Office Re. U.S. Appl. No. 17/019,281. (7 Pages).
Restriction Official Action dated Jul. 7, 2021 from the US Patent and Trademark Office Re. U.S. Appl. No. 17/019,280. (5 pages).
Restriction Official Action dated Jul. 7, 2021 from the US Patent and Trademark Office Re. U.S. Appl. No. 17/019,281, (5 pages).
Examination Report dated Sep. 7, 2018 From the Government of India, Patent Office, Intellectual Property Building Re.: Application No. 309690.
Examination Report dated Sep. 11, 2018 From the Government of India, Patent Office, Intellectual Property Building Re.: Application No. 309744.
International Preliminary Report on Patentability dated Sep. 24, 2020 From the International Bureau of WIPO Re. Application No. PCT/IB2019/052016. (7 Pages).
International Preliminary Report on Patentability dated Sep. 24, 2020 From the International Bureau of WIPO Re. Application No. PCT/IB2019/052008. (6 Pages).
International Preliminary Report on Patentability dated Sep. 24, 2020 From the International Bureau of WIPO Re. Application No. PCT/IB2019/052010. (7 Pages).
International Preliminary Report on Patentability dated Sep. 24, 2020 From the International Bureau of WIPO Re. Application No. PCT/IB2019/052014. (7 Pages).
International Preliminary Report on Patentability dated Sep. 24, 2020 From the International Bureau of WIPO Re. Application No. PCT/IB2019/052017. (7 Pages).

(56) References Cited

OTHER PUBLICATIONS

International Search Report and the Written Opinion dated Jul. 3, 2019 From the International Searching Authority Re. Application No. PCT/IB2019/052014. (16 Pages).
International Search Report and the Written Opinion dated Jul. 3, 2019 From the International Searching Authority Re. Application No. PCT/IB2019/052017. (14 Pages).
International Search Report and the Written Opinion dated Sep. 17, 2019 From the International Searching Authority Re. Application No. PCT/IB2019/054141. (11 Pages).
International Search Report and the Written Opinion dated Jun. 26, 2019 From the International Searching Authority Re. Application No. PCT/IB2019/052016. (15 Pages).
International Search Report and the Written Opinion dated Jun. 27, 2019 From the International Searching Authority Re. Application No. PCT/IB2019/052007. (12 Pages).
International Search Report and the Written Opinion dated Jun. 27, 2019 From the International Searching Authority Re. Application No. PCT/IB2019/052008. (10 Pages).
International Search Report and the Written Opinion dated Jun. 27, 2019 From the International Searching Authority Re. Application No. PCT/IB2019/052010. (17 Pages).
Notice of Amendment dated Dec. 11, 2018 From the State Intellectual Property Office of the People's Republic of China Re. Application No. 201830508569.8. (2 pages).
Notification of Reason for Rejection dated Jan. 30, 2019 From the Japanese Patent Office Re. Application No. 2018-019747. (2 Pages).
Official Action dated Jun. 12, 2020 from the US Patent and Trademark Office Re. U.S. Appl. No. 29/640,027. (19 pages).
Official Action dated Jun. 12, 2020 from the US Patent and Trademark Office Re. U.S. Appl. No. 29/640,032. (13 pages).
Official Action dated Jun. 25, 2020 from the US Patent and Trademark Office Re. U.S. Appl. No. 29/653,164. (9 pages).
Cho "Characterization of Potential Probiotics Bacillus Subtilis CS90 From Soybean Paste (Doenjang) and Its Antimicrobial Activity Against Food-Borne Pathogens", Journal of Applied Biological Chemistry, 51(5): 285-291, 2008.
Gu et al. "The Preventive Effect and Therapeutic Effect of Spraying Agent of Bacillus Pab02 on Respiratory Infection in Broilers", Proceedings of the 10th in the 4th National Academic Seminar and Animal Micro-Ecology Enterprise Development Forum, p. 450-458, Aug. 1, 2010.
Jeon et al. "Screening and Characterization of Potential Bacillus Starter Cultures for Fermenting Low-Salt Soybean Past (Doenjang)", Journal of Microbiology and Biotechnology, 26(4): 666-674, Apr. 2016.
Ji et al. "Probiotic Bacillus Amyloliquefaciens SC06 Prevents Bacterial Translocation in Weaned Mice", Indian Journal of Microbiology, 53(3): 323-328, Published Online Mar. 16, 2013.
Wong et al. "An Antifungal Protein From Bacillus Amyloliquefaciens", Journal of Applied Microbiology, 105(6): 1888-1898, Dec. 2008.
Xie et al. "Isolation and Characterization of A Bacteriocin Produced by an Isolated Bacillus Subtihs LFB112 That Exhibits Antimicrobial Activity Against Domestic Animal Pathogens", African Journal of Biotechnology, 8(20): 5611-5619, Oct. 19, 2009.
Restriction Official Action dated Jul. 13, 2021 from the US Patent and Trademark Office Re. U.S. Appl. No. 17/019,568. (5 pages).
Official Action dated Sep. 22, 2021 from the US Patent and Trademark Office Re. U.S. Appl. No. 17/019,280. (26 pages).
International Preliminary Report on Patentability dated Sep. 24, 2020 From the International Bureau of WIPO Re. Application No. PCT/IB2019/052007. (6 Pages).
Notice of Allowance dated Mar. 24, 2022 from US Patent and Trademark Office Re. U.S. Appl. No. 17/019,280. (4 pages).

\* cited by examiner

| | | |
|---|---|---|
|  |  |  |
| *Escherichia coli* ATCC 22922 | *Pseudomonas aeruginosa* | *Bacillus cereus* ATCC 27348 |
|  |  |  |
| *Staphylococcus aureus* ATCC 11335 | *Salmonella typhi* ATCC 14028 | *Listeria inocua* ATCC 3586 |

| | | |
|---|---|---|
|  |  |  |
| *Alternaria alternata* (Fries) Keissler ATCC® MYA-4642™ | *Cladosporium sphaerospermum* Penzig ATCC® MYA-4645™ | *Penicillium chrysogenum* Thom ATCC® MYA-4644™ |

COMPOSITIONS COMPRISING BACTERIAL STRAINS AND USE THEREOF IN CONTROLLING PATHOGENIC MICROORGANISMS

RELATED APPLICATIONS

This application is a US Continuation of PCT Patent Application No. PCT/IB2019/052016 having international filing date of Mar. 12, 2019 which claims the benefit of priority under 35 USC § 119(e) of U.S. Provisional Patent Application Nos. 62/641,443, 62/641,444, 62/641,445 and 62/641,464, all filed on Mar. 12, 2018. The contents of the above applications are all incorporated by reference as if fully set forth herein in their entirety.

PCT Patent Application No. PCT/IB2019/052016 is also related to co-filed PCT Patent Application Nos. PCT/IB2019/052008, PCT/IB2019/052007, PCT/IB2019/052010, PCT/IB2019/052017 and PCT/IB2019/052014 entitled "CARTRIDGE FOR AN AUTOMATED AEROSOL DISPENSING DEVICE", "ELECTRONIC SAFETY FEATURE FOR AN AUTOMATED AEROSOL DISPENSING DEVICE", "COMPOSITIONS COMPRISING BACTERIAL STRAINS AND USE THEREOF IN CONTROLLING PATHOGENIC MICROORGANISMS", "COMPOSITIONS COMPRISING BACTERIAL STRAINS AND USE THEREOF IN CONTROLLING PATHOGENIC MICROORGANISMS", "COMPOSITIONS COMPRISING BACTERIAL STRAINS AND USE THEREOF IN CONTROLLING PATHOGENIC MICROORGANISMS". The contents of the above applications are all incorporated by reference as if fully set forth herein in their entirety.

SEQUENCE LISTING STATEMENT

The ASCII file, entitled 84587SequenceListing.txt, created on Sep. 14, 2020, comprising 15,755,105 bytes, submitted concurrently with the filing of this application is incorporated herein by reference.

FIELD AND BACKGROUND OF THE INVENTION

The present invention, in some embodiments thereof, relates to compositions comprising bacterial strains and use thereof in controlling pathogenic microorganisms.

A respiratory tract infection (RTI) refers to any of a number of infectious diseases involving the respiratory tract. An infection of this type is normally further classified as an upper respiratory tract infection (URI or URTI) or a lower respiratory tract infection (LRI or LRTI). Lower respiratory infections, such as pneumonia, tend to be far more serious conditions than upper respiratory infections, such as the common cold.

Identifying probiotic microbial strains which can be used in the effective and safe treatment and prophylaxis of respiratory tract infections is therefore highly desired.

Additional background art includes:

Jeon, Jung et al. 2016 *J. Microbiol. Biotechnol* 26(4): 666-674;

Cho 2008 Journal of Applied Biological Chemistry 51(6): 285-291;

U.S. Publication No. 20170348364;

U.S. Pat. No. 8,986,610.

SUMMARY OF THE INVENTION

According to an aspect of some embodiments of the present invention there is provided a composition comprising at least two bacterial strains selected from the group consisting of *Bacillus subtilis* 281, *Bacillus subtilis* 3, *Bacillus amyloliquefaciens* 298 and a functional homolog of any of the preceding, wherein the composition does not comprise more than 5 different species of microbes, wherein:

a sample of *Bacillus subtilis* 281, has been deposited as KCTC 13468BP at the Korean Collection for Type Cultures;

a sample of *Bacillus subtilis* 3, has been deposited as KCTC 13467BP at the Korean Collection for Type Cultures; and a sample of *Bacillus amyloliquefaciens* 298, has been deposited as KCTC 13469BP at the Korean Collection for Type Cultures.

According to an aspect of some embodiments of the present invention there is provided an article of manufacture comprising at least two bacterial strains selected from the group consisting of *Bacillus subtilis* 281, *Bacillus subtilis* 3, *Bacillus amyloliquefaciens* 298 and a functional homolog of any of the preceding, wherein the composition does not comprise more than 5 different species of microbes, wherein:

a sample of *Bacillus subtilis* 281, has been deposited as KCTC 13468BP at the Korean Collection for Type Cultures;

a sample of *Bacillus subtilis* 3, has been deposited as KCTC 13467BP at the Korean Collection for Type Cultures; and a sample of *Bacillus amyloliquefaciens* 298, has been deposited as KCTC 13469BP at the Korean Collection for Type Cultures.

According to some embodiments of the invention, said bacterial strain or functional homolog of same is attached to a solid support.

According to some embodiments of the invention, said bacterial strain or functional homolog of same is soluble.

According to some embodiments of the invention, the article of manufacture comprises a commodity selected from the group consisting of a food, a feed, a beverage, a pharmaceutical, a nutraceutical, a cosmetic, a filter, a matrix and an aerosol system.

According to an aspect of some embodiments of the present invention there is provided an aerosol dispensing device comprising an effective amount of at least two bacterial strains selected from the group consisting of *Bacillus subtilis* 281, *Bacillus subtilis* 3, *Bacillus amyloliquefaciens* 298 and a functional homolog of any of the preceding, wherein the composition does not comprise more than 5 different species of microbes, wherein:

a sample of *Bacillus subtilis* 281, has been deposited as KCTC 13468BP at the Korean Collection for Type Cultures;

a sample of *Bacillus subtilis* 3, has been deposited as KCTC 13467BP at the Korean Collection for Type Cultures; and a sample of *Bacillus amyloliquefaciens* 298, has been deposited as KCTC 13469BP at the Korean Collection for Type Cultures.

According to some embodiments of the invention, the aerosol dispensing device is automated.

According to some embodiments of the invention, said bacterial strain or said functional homolog comprises a genomic nucleic acid sequence at least 97% identical to the nucleic acid sequence set forth in SEQ ID NO: 4, 6 or 8.

According to some embodiments of the invention, said bacterial strain or said functional homolog exhibits:

(i) growth inhibitory effects against bacteria and fungi, as shown in Tables 3, 4, 8, 9, 13, 14, 18 and 19.

(ii) no lecithinase activity as determined by the absence of a white precipitate when the isolated bacterial strain or functional homolog of same is streaked out onto egg yolk agar and incubated for 24 h at 37° C.; and (iii) gamma hemolytic activity when streaked onto 5% sheep blood agar and incubated for 24 h at 37° C.

According to some embodiments of the invention, the bacterial strain or functional homolog of same is sensitive to an antibiotic selected from the group consisting of erythromycin, gentamicin, tetracycline, streptomycin, vancomycin, chloramphenicol, kanamycin and clindamycin according to the European Food Safety Authority MIC breakpoints for *Bacillus* species.

According to some embodiments of the invention, the bacterial strain or functional homolog of same is incapable of colonizing a mammalian lung.

According to some embodiments of the invention, the bacterial strain or functional homolog of same exhibits growth inhibitory effects against bacteria and fungi, as shown in Tables 3, 4, 8, 9, 13, 14, 18 and 19.

According to some embodiments of the invention, said functional homolog is characterized by at least one of:

at least 70% DNA-DNA relatedness to the deposited strain with 5 uC or less DTm;

at least 97% genomic DNA sequence identity to the genomic DNA sequence of the deposited strain;

having an average nucleotide identity (ANI) of at least about 97% with the deposited strain;

having a tetranucleotide signature frequency correlation coefficient of at least about 0.99 with the deposited strain;

having a Dice similarity coefficient;

being of the same ribotype as that of the deposited strain;

having a Pearson correlation coefficient of at least about 0.99 with the deposited strain;

having a multilocus sequence typing (MLST) of at least about 0.99 with the deposited strain;

having a functionality conserved gene that is at least about 97% identical to that of the deposited strain as determined at a level of a single gene or multilocus sequence analysis (MLSA);

having a 16S nucleic acid sequence that is at least about 97% identical to that of the deposited strain;

having substantially the same biochemical profiling as determined by the GEN III redox chemistry;

maintaining the coding and/or non-coding sequence order as that of the deposited strain;

having the same codon usage as that of the deposited strain.

According to some embodiments of the invention, the composition, article of manufacture or device comprises *Bacillus subtilis* 281, *Bacillus subtilis* 3 and *Bacillus amyloliquefaciens* 298 or a functional homolog of same.

According to some embodiments of the invention, said *Bacillus subtilis* 281, *Bacillus subtilis* 3 and *Bacillus amyloliquefaciens* 298 or a functional homolog of same are present in a ration of about 1:1:1.

According to an aspect of some embodiments of the present invention there is provided a method of controlling a population of pathogenic bacteria and/or fungi, the method comprising providing an effective amount of the composition, thereby controlling the population of pathogenic bacteria and/or fungi.

According to some embodiments of the invention, said controlling is prophylactic.

According to some embodiments of the invention, said controlling is therapeutic.

According to some embodiments of the invention, said contacting comprises in vivo contacting.

According to some embodiments of the invention, said contacting is by inhalation.

According to some embodiments of the invention, said contacting is by oral administration.

According to some embodiments of the invention, said contacting is by enteral administration.

According to some embodiments of the invention, said contacting is by paraenteral administration.

According to some embodiments of the invention, said contacting comprises in vitro contacting.

According to some embodiments of the invention, said contacting is by using the aerosol dispensing device.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWING(S)

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

DESCRIPTION OF SPECIFIC EMBODIMENTS OF THE INVENTION

Figure 1:
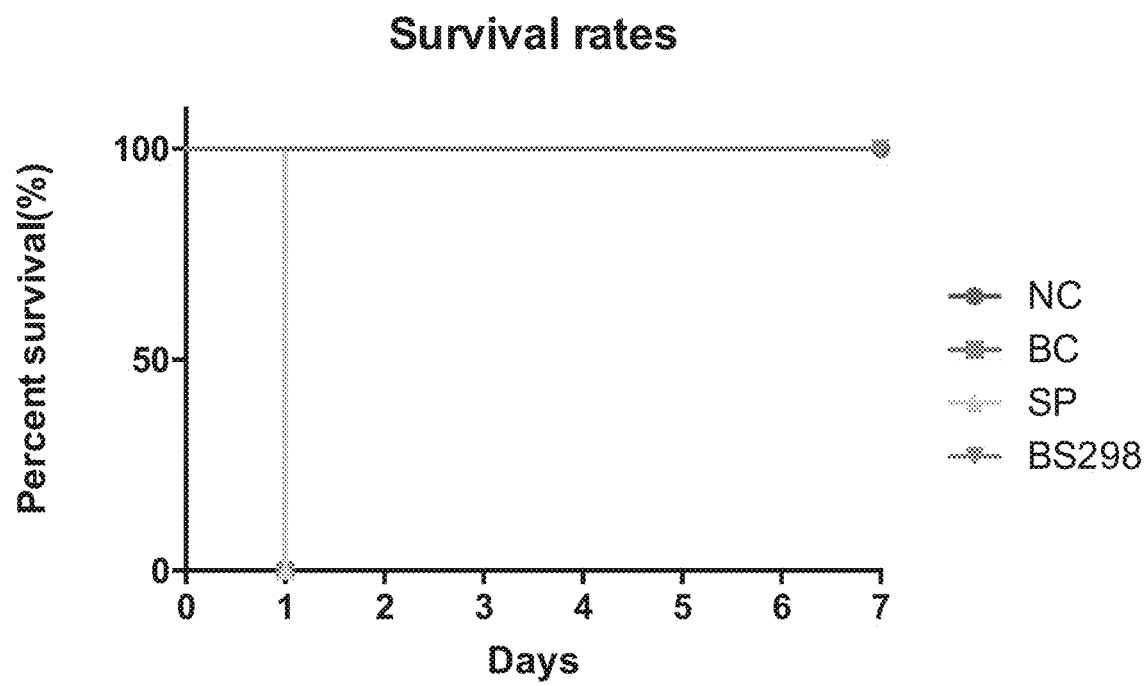
FIG. 1 is a graph showing the survival rates of mice after respiratory tract infection (NC: negative control, BC: *B. cereus*, SP: *S. pneumoniae*, BS298: *B. amyloliquefaciens* 298).

The present invention, in some embodiments thereof, relates to compositions comprising bacterial strains and use thereof in controlling pathogenic microorganisms. Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

In a search for probiotic bacterial strains that can be effectively and safely used in controlling pathogenic microorganisms, the present inventors have identified a novel strains of *Bacillus* strains. The pathogenicity of the strains was assessed using in-vitro methods such as lecithinase activity, hemolysis tests and resistance to therapeutic antibiotics. Safety was also evaluated in-vivo through a lung infection model in mice. Lastly, the efficacy of the strains in inhibiting the growth of pathogenic microorganisms was affirmed in-vitro.

Collectively these assays place the compositions described according to some embodiments as both safe for respiratory tract infection and functional with high potential to be used in various domestic, clinical and industrial applications.

According to an aspect of some embodiments of the present invention there is provided a composition comprising at least two bacterial strains selected from the group consisting of *Bacillus subtilis* 281, *Bacillus subtilis* 3, *Bacillus amyloliquefaciens* 298 and a functional homolog of any of the preceding, wherein the composition does not comprise more than 5 different species of microbes, wherein:

a sample of *Bacillus subtilis* 281, has been deposited as KCTC 13468BP at the Korean Collection for Type Cultures;

a sample of *Bacillus subtilis* 3, has been deposited as KCTC 13467BP at the Korean Collection for Type Cultures; and a sample of *Bacillus amyloliquefaciens* 298, has been deposited as KCTC 13469BP at the Korean Collection for Type Cultures.

According to an aspect of some embodiments of the present invention there is provided an article of manufacture comprising at least two bacterial strains selected from the group consisting of *Bacillus subtilis* 281, *Bacillus subtilis* 3, *Bacillus amyloliquefaciens* 298 and a functional homolog of any of the preceding, wherein the composition does not comprise more than 5 different species of microbes, wherein:

a sample of *Bacillus subtilis* 281, has been deposited as KCTC 13468BP at the Korean Collection for Type Cultures;

a sample of *Bacillus subtilis* 3, has been deposited as KCTC 13467BP at the Korean Collection for Type Cultures; and a sample of *Bacillus amyloliquefaciens* 298, has been deposited as KCTC 13469BP at the Korean Collection for Type Cultures.

According to some embodiments of the invention, said bacterial strain or functional homolog of same is attached to a solid support.

According to some embodiments of the invention, said bacterial strain or functional homolog of same is soluble.

According to some embodiments of the invention, the article of manufacture comprises a commodity selected from the group consisting of a food, a feed, a beverage, a pharmaceutical, a nutraceutical, a cosmetic, a filter, a matrix and an aerosol system.

According to an aspect of some embodiments of the present invention there is provided an aerosol dispensing device comprising an effective amount of at least two bacterial strains selected from the group consisting of *Bacillus subtilis* 281, *Bacillus subtilis* 3, *Bacillus amyloliquefaciens* 298 and a functional homolog of any of the preceding, wherein the composition does not comprise more than 5 different species of microbes, wherein:

a sample of *Bacillus subtilis* 281, has been deposited as KCTC 13468BP at the Korean Collection for Type Cultures;

a sample of *Bacillus subtilis* 3, has been deposited as KCTC 13467BP at the Korean Collection for Type Cultures; and a sample of *Bacillus amyloliquefaciens* 298, has been deposited as KCTC 13469BP at the Korean Collection for Type Cultures.

According to some embodiments of the invention, the aerosol dispensing device is automated.

According to some embodiments of the invention, said bacterial strain or said functional homolog comprises a genomic nucleic acid sequence at least 97% identical to the nucleic acid sequence set forth in SEQ ID NO: 4, 6 or 8.

According to some embodiments of the invention, said bacterial strain or said functional homolog exhibits:

(i) growth inhibitory effects against bacteria and fungi, as shown in Tables 3, 4, 8, 9, 13, 14, 18 and 19.

(ii) no lecithinase activity as determined by the absence of a white precipitate when the isolated bacterial strain or functional homolog of same is streaked out onto egg yolk agar and incubated for 24 h at 37° C.; and (iii) gamma hemolytic activity when streaked onto 5% sheep blood agar and incubated for 24 h at 37° C.

According to some embodiments of the invention, the bacterial strain or functional homolog of same is sensitive to an antibiotic selected from the group consisting of erythromycin, gentamicin, tetracycline, streptomycin, vancomycin, chloramphenicol, kanamycin and clindamycin according to the European Food Safety Authority MIC breakpoints for *Bacillus* species.

According to some embodiments of the invention, the bacterial strain or functional homolog of same is incapable of colonizing a mammalian lung.

According to some embodiments of the invention, the bacterial strain or functional homolog of same exhibits growth inhibitory effects against bacteria and fungi, as shown in Tables 3, 4, 8, 9, 13, 14, 18 and 19.

According to some embodiments of the invention, said functional homolog is characterized by at least one of:

at least 70% DNA-DNA relatedness to the deposited strain with 5 uC or less DTm;

at least 97% genomic DNA sequence identity to the genomic DNA sequence of the deposited strain;

having an average nucleotide identity (ANI) of at least about 97% with the deposited strain;

having a tetranucleotide signature frequency correlation coefficient of at least about 0.99 with the deposited strain;

having a Dice similarity coefficient;

being of the same ribotype as that of the deposited strain;

having a Pearson correlation coefficient of at least about 0.99 with the deposited strain;

having a multilocus sequence typing (MLST) of at least about 0.99 with the deposited strain;

having a functionality conserved gene that is at least about 97% identical to that of the deposited strain as determined at a level of a single gene or multilocus sequence analysis (MLSA);

having a 16S nucleic acid sequence that is at least about 97% identical to that of the deposited strain;

having substantially the same biochemical profiling as determined by the GEN III redox chemistry;

maintaining the coding and/or non-coding sequence order as that of the deposited strain;

having the same codon usage as that of the deposited strain.

According to some embodiments of the invention, the composition, article of manufacture or device comprises *Bacillus subtilis* 281, *Bacillus subtilis* 3 and *Bacillus amyloliquefaciens* 298 or a functional homolog of same.

According to some embodiments of the invention, said *Bacillus subtilis* 281, *Bacillus subtilis* 3 and *Bacillus amyloliquefaciens* 298 or a functional homolog of same are present in a ration of about 1:1:1.

According to an aspect of some embodiments of the present invention there is provided a method of controlling a population of pathogenic bacteria and/or fungi, the method comprising providing an effective amount of the composition, thereby controlling the population of pathogenic bacteria and/or fungi.

According to some embodiments of the invention, said controlling is prophylactic.

According to some embodiments of the invention, said controlling is therapeutic.

According to some embodiments of the invention, said contacting comprises in vivo contacting.

According to some embodiments of the invention, said contacting is by inhalation.

According to some embodiments of the invention, said contacting is by oral administration.

According to some embodiments of the invention, said contacting is by enteral administration.

According to some embodiments of the invention, said contacting is by paraenteral administration.

According to some embodiments of the invention, said contacting comprises in vitro contacting.

According to some embodiments of the invention, said contacting is by using the aerosol dispensing device.

KCTC 13469BP has been deposited in the Korean Collection for Type Cultures, Korea Research Institute of Bioscience and Biotechnology (KRIBB) 181, Ipsin-gil, Jeongeup-si, Jeolllabuk-do 56212, Republic of Korea on Jan. 25, 2018.

The bacterial strain can be as deposited or a variant thereof, also referred to herein as a "functional homolog".

KCTC 13467BP has been deposited in the Korean Collection for Type Cultures, Korea Research Institute of Bioscience and Biotechnology (KRIBB) 181, Ipsin-gil, Jeongeup-si, Jeolllabuk-do 56212, Republic of Korea on Jan. 25, 2018.

The bacterial strain can be as deposited or a variant thereof, also referred to herein as a "functional homolog".

KCTC 13468BP has been deposited in the Korean Collection for Type Cultures, Korea Research Institute of Bioscience and Biotechnology (KRIBB) 181, Ipsin-gil, Jeongeup-si, Jeolllabuk-do 56212, Republic of Korea on Jan. 25, 2018.

The bacterial strain can be as deposited or a variant thereof, also referred to herein as a "functional homolog".

The term "the microbial strain" or "the bacterial strain" can refer to the deposited strain and/or the functional homolog.

As used herein "functional homolog" or "functionally homologous" or "variant" or a grammatical equivalent as used herein, refers to a modification (i.e., at least one mutation) of the deposited microbial strain resulting in a microbial strain that is endowed with substantially the same ensemble of biological activities (+/−10%, 20%, 40%, 50%, 60% when tested under the same conditions) as that of the deposited strain (see hereinbelow and in the Examples section which follows) and can be classified to the same species or strain based on known methods of species/strain classifications.

Following are non-limiting criteria for identifying a functional homolog. These criteria, which are mostly genetic, combined with the functional characteristic as defined hereinbelow and in the Examples section, which follows, will be facilitate the skilled artisan in defining the scope of the functional homolog.

Thus, according to a specific embodiment, the deposited strain and the functional homolog belong to the same operational taxonomic units (OTU).

An "OTU" (or plural, "OTUs") refers to a terminal leaf in a phylogenetic tree and is defined by a nucleic acid sequence, e.g., the entire genome, or a specific genetic sequence, and all sequences that share sequence identity to this nucleic acid sequence at the level of species. In some embodiments the specific genetic sequence may be the 16S-rRNA sequence or a portion of the 16S-rRNA (also referred to herein as "16S") sequence or other functionally conserved genes as listed below. In other embodiments, the entire genomes of two entities are sequenced and compared. In another embodiment, selected regions such as multilocus sequence tags (MLST, MLSA), specific genes, or sets of genes may be genetically compared. In 16S-rRNA embodiments, OTUs that share at least 97% average nucleotide identity across the entire 16S or some variable region of the 16S are considered the same OTU (see e.g. Claesson M J, Wang Q, O'Sullivan O, Greene-Diniz R, Cole J R, Ros R P, and O'Toole P W. 2010. Comparison of two next-generation sequencing technologies for resolving highly complex microbiota composition using tandem variable 16S rRNA gene regions. Nucleic Acids Res 38: e200. Konstantinidis K T, Ramette A, and Tiedje J M. 2006. The bacterial species definition in the genomic era. Philos Trans R Soc Lond B Biol Sci 361: 1929-1940). In embodiments involving the complete genome, MLSTs, specific genes, or sets of genes OTUs that share at least 95% average nucleotide identity are considered the same OTU (see e.g. Achtman M, and Wagner M. 2008. Microbial diversity and the genetic nature of microbial species. Nat. Rev. Microbiol. 6: 431-440. Konstantinidis K T, Ramette A, and Tiedje J M. 2006. The bacterial species definition in the genomic era. Philos Trans R Soc Lond B Biol Sci 361: 1929-1940). OTUs are frequently defined by comparing sequences between organisms. Such characterization employs, e.g., WGS data or a whole genome sequence.

According to a specific embodiment, the classification is based on DNA-DNA pairing data and/or sequence identity to functionally conserved genes or fragments thereof.

According to a specific embodiment a species/strain can be defined by DNA-DNA hybridization involving a pairwise comparison of two entire genomes and reflects the overall sequence similarity between them. According to a specific embodiment, a species is defined as a set of strains with at least about 70%, e.g., at least about 75%, at least about 80%, at least about 85%, at least about 90%, at least about 91%, at least about 92%, at least about 93%, at least about 94%, at least about 95% or more DNA-DNA relatedness and with 5 uC or less DTm and having the activities as defined hereinbelow and in the Examples section which follows.

According to a specific embodiment, the genomic nucleic acid sequence is at least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95% 99.95%, at least about 99.99%, at least about 99.999%, at least about 99.9999%, at least about 99.99999%, at least about 99.999999% or more DNA-DNA relatedness and with 5 uC or less DTm and having the activities hereinbelow and in the Examples section which follows.

Thus, for example, if there is DNA-DNA hybridization on the basis of the article of Goris et al. [Goris, J., Konstantinidis, K. T., Klappenbach, J. A., Coenye, T., Vandamme, P., and Tiedje, J M. (2007). DNA-DNA hybridization values and their relationship to whole-genome sequence similarities. Int J Syst Evol Microbiol 57:81-91], some microorganisms expressing a DNA-DNA relatedness value of 70% or more (as described above) can be regarded as functional homologs according to some embodiments of the invention.

According to a specific embodiment, the reference genomic sequence is as set forth in SEQ ID NO: 4, 6 or 8.

As used herein, "sequence identity" or "identity" or grammatical equivalents as used herein in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9].

Identity can be determined using any homology comparison software, including for example, the BlastN software of the National Center of Biotechnology Information (NCBI) such as by using default parameters.

According to some embodiments of the invention, the identity is a global identity, i.e., an identity over the entire nucleic acid sequences of the invention and not over portions thereof.

According to a specific embodiment, the genomic nucleic acid sequence is at least about 70%, e.g., at least 75%, at least about 80%, at least about 85%, at least about 90%, at least about 91%, at least about 92%, at least about 93%, at least about 94%, at least about 95%, at least about 96% least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95% 99.95%, at least about 99.99%, at least about 99.999%, at least about 99.9999%, at least about 99.99999%, at least about 99.999999% or more to the genomic sequence of the deposited strain (SEQ ID NO: 4, 6 or 8).

According to a specific embodiment, the genomic nucleic acid sequence is at least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, 99.95%, at least about 99.99%, at least about 99.999%, at least about 99.9999%, at least about 99.99999%, at least about 99.999999% or more identical to that of the deposited strain (SEQ ID NO: 4, 6 or 8).

According to an additional or alternative embodiment, a functional homolog is determined as the average nucleotide identity (ANI), which detects the DNA conservation of the core genome (Konstantinidis K and Tiedje J M, 2005, Proc. Natl. Acad. Sci. USA 102: 2567-2592). In some embodiments, the ANI between the functional homolog and the deposited strain is of at least about 95%, at least about, 96%, at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more.

According to an additional or alternative embodiment, a functional homolog is determined by the degree of relatedness between the functional homolog and deposited strain determined as the Tetranucleotide Signature Frequency Correlation Coefficient, which is based on oligonucleotide frequencies (Bohlin J. et al. 2008, BMC Genomics, 9:104). In some embodiments, the Tetranucleotide Signature Frequency Correlation coefficient between the variant and the deposited strain is of about 0.99, 0.999, 0.9999, 0.99999, 0.999999, 0.999999 or more.

According to an additional or alternative embodiment, the degree of relatedness between the functional homolog and the deposited strain is determined as the degree of similarity obtained when analyzing the genomes of the parent and of the variant strain by Pulsed-field gel electrophoresis (PFGE) using one or more restriction endonucleases. The degree of similarity obtained by PFGE can be measured by the Dice similarity coefficient. In some embodiments, the Dice similarity coefficient between the variant and the deposited strain is of at least about 96%, at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more.

According to an additional or alternative embodiment, the functional homolog is defined as having the same ribotype, as obtained using any of the methods known in the art and described, for instance, by Bouchet et al. (Clin. Microbiol. Rev., 2008, 21:262-273).

According to an additional or alternative embodiment, the degree of relatedness between the functional homolog and the deposited strain is determined by the Pearson correlation coefficient obtained by comparing the genetic profiles of both strains obtained by repetitive extragenic palindromic element-based PCR (REP-PCR) (see e.g. Chou and Wang, Int J Food Microbiol. 2006, 110:135-48). In some embodiments, the Pearson correlation coefficient obtained by comparing the REP-PCR profiles of the variant and the deposited strain is of at least about 0.99, at least about 0.999, at least about 0.9999, at least about 0.99999, at least about 0.999999, at least about 0.999999 or more.

According to an additional or alternative embodiment, the degree of relatedness between the functional homolog and the deposited strains is defined by the linkage distance obtained by comparing the genetic profiles of both strains obtained by Multilocus sequence typing (MLST) (see e.g. Maiden, M. C., 1998, Proc. Natl. Acad. Sci. USA 95:3140-3145). In some embodiments, the linkage distance obtained by MLST of the functional homolog and the deposited strain is of at least about 0.99, at least about 0.999, at least about 0.9999, at least about 0.99999, at least about 0.999999, at least about 0.999999 or more.

According to an additional or alternative embodiment, the functional homolog comprises a functionally conserved gene or a fragment thereof e.g., a house-keeping gene e.g., 16S-rRNA or Internal Transcribed Spacer" (ITS), recA, glnII, atpD, gap, glnA, gltA, gyrB, pnp, rpoB, thrC or dnaK that is at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more identical to that of the deposited strain.

As mentioned, and according to a specific additional or an alternative embodiment, a functional homolog can also be determined on the basis of a multilocus sequence analysis (MLSA) determination of various functionally conserved genes or fragments thereof e.g., at least one, 2, 3, 4, 5, 6, 7, 8, 9, 10, 11, 12, 13, 14, 15 or more functionally conserved genes or fragments thereof, such as of e.g., 16S, ITS, recA, glnII, atpD, gap, glnA, gltA, gyrB, pnp, rpoB, thrC and dnaK.

According to a specific embodiment, the 16S ribosomal RNA (16S-rRNA) nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain (SEQ ID NO: 3, 5 or 7).

According to a specific embodiment, the ITS nucleic acid sequence is at least about 97%, e.g. at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the recA nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the atpD nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the dnaK nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the glnII nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gap nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the glnA nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gltA nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gyrB nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the pnp nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the rpoB nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the thrC nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to an additional or alternative embodiment the deposited strain and the functional homolog is characterized by substantially the same (+/−about 10%, 20%, 40%, 50%, 60% when tested under the same conditions) biochemical profiling (e.g., biochemical fingerprinting) using for example, the GEN III redox chemistry (BIOLOG Inc. 21124 Cabot Blvd. Hayward Calif., 94545, USA), which can analyze both Gram-negative and Gram-positive bacteria, for their ability to metabolize all major classes of biochemicals, in addition to determining other important physiological properties such as pH, salt, and lactic acid tolerance. Further details can be obtained in "Modern Phenotypic Microbial Identification", B. R. Bochner, Encyclopedia of Rapid Microbiological Methods, 2006, v.2, Ch. 3, pp. 55-73, which is incorporated herein by reference in its entirety.

Example 7 of the Examples section provides a metabolite analysis of the deposited strain.

According to an additional or alternative embodiment, the functional homolog is defined by a comparison of coding sequences (gene) order.

According to an additional or alternative embodiment, the functional homolog is defined by a comparison of order of non-coding sequences.

According to an additional or alternative embodiment, the functional homolog is defined by a comparison of order of coding and non-coding sequences.

According to some embodiments of the invention, the combined coding region of the functional homolog is such that it maintains the original order of the coding regions as within the genomic sequence of the bacterial isolate yet without the non-coding regions.

Coding sequences of the deposited strain and their annotations are provided in Table 5 of the Examples section which follows.

For example, in case the genomic sequence has the following coding regions, A, B, C, D, E, F, G, each flanked by non-coding sequences (e.g., regulatory elements, introns and the like), the combined coding region will include a single nucleic acid sequence having the A+B+C+D+E+F+G coding regions combined together while maintaining the original order of their genome, yet without the non-coding sequences.

According to some embodiments of the invention, the combined non-coding region of the functional homolog is such that it maintains the original order of the non-coding regions as within the genomic sequence of the bacterial isolate yet without the coding regions as originally present in the bacterial deposit.

According to some embodiments of the invention, the combined non-coding region and coding region (i.e., the genome) of the functional homolog is such that it maintains the original order of the coding and non-coding regions as within the genomic sequence of the microbial deposit.

As used herein "maintains" relate to at least about 90%, 91%, 92%, 93%, 94%, 95%, 96%, 97%, 98%, 99% or 100% is maintained as compared to the deposited strain.

According to an additional or alternative embodiment, the functional homolog is defined by a comparison of gene content.

According to a specific embodiment, the functional homolog comprises a combined coding region where at least about 90%, at least about 91%, at least about 92%, at least about 93%, at least about 94%, at least about 95%, at least about 96%, at least about 97%, at least about 98%, at least about 99%, or more (e.g., 100%) is identical to a combined coding region existing in genome of the deposited strain.

As used herein "combined coding region" refers to a nucleic acid sequence including all of the coding regions of the bacterial isolate yet without the non-coding regions of the bacterial isolate.

According to an additional or alternative embodiment, the functional homolog is defined by a comparison of nucleotide composition and codon usage.

According to an additional or alternative embodiment, the functional homolog is defined by a method based on random genome fragments and DNA microarray technology. These methods are of sufficiently high resolution to for strain-to-species level identification.

One of ordinary skill in the art, based on knowledge of the classification criteria would know how to identify strains that are considered functional homologs.

An additional and more detailed description of species-to-strain classification can be found in:

Cho and Tiedje 2001 Bacterial species determination from DNA-DNA hybridization by using genome fragments and DNA microarrays;

Coenye et al. 2005 Towards a prokaryotic genomic taxonomy. FEMS Microbiol. Rev. 29:147-167;

Konstantinidis and Tiedje (2005) Genomic insights that advance the species definition for prokaryotes. Proc. Natl. Acad. Sci. USA 102:189-197;

Konstantinidis et al. 2006 Toward a more robust assessment of intraspecies diversity using fewer genetic markers. Appl. Environ. Microbiol. 72:7286-7293.

It is to be understood that one or more methods as described herein can be used to identify a functional homolog.

Genomic data can be obtained by methods which are well known in the art e.g., DNA sequencing, bioinformatics, electrophoresis, an enzyme-based mismatch detection assay and a hybridization assay such as PCR, RT-PCR, RNase protection, in-situ hybridization, primer extension, Southern blot, Northern Blot and dot blot analysis.

According to a specific embodiment, the functional homolog and the deposited strain belong to the same species (Bacillus amyloliquefaciens).

According to a specific embodiment, the functional homolog and the deposited strain belong to the same subspecies.

As mentioned, the functional homolog is endowed with or maintains (as defined herein) the functional properties of the deposited strain.

Thus according to a specific embodiment, the bacterial strain has no lecithinase activity as determined by the absence of a white precipitate when the isolated bacterial strain or functional homolog of same is streaked out onto egg yolk agar and incubated for 24 h at 37° C.

According to an additional or an alternative embodiment, the bacterial strain exhibits gamma hemolytic activity when streaked onto 5% sheep blood agar and incubated for 24 h at 37° C.

According to an additional or an alternative embodiment, the bacterial strain is sensitive to an antibiotic selected from the group consisting of erythromycin, gentamicin, tetracycline, streptomycin, vancomycin, chloramphenicol, kanamycin and clindamycin according to the European Food Safety Authority MIC breakpoints for Bacillus species such as shown in Table 2 hereinbelow.

According to an additional or an alternative embodiment, the bacterial strain is incapable of colonizing a mammalian (e.g., murine) lung.

According to an additional or an alternative embodiment, the bacterial strain is growth inhibitory effects against bacteria and fungi, as shown in Tables 3 and 4, respectively.

According to an additional or an alternative embodiment, the bacterial strain exhibits a secreted metabolome composition as shown in the Examples section which follows. As used herein "isolated" refers to an isolate of bacteria in which the prevalence (i.e., concentration) of the bacterial stain or functional homolog is enriched over that (exceeds that) found in nature (e.g., in Doenjang, a fermented soybean paste). Thus, the present teachings refer to cultures, preparations, compositions (interchangeably used), which comprise the bacterial strain.

The isolated bacterial strain can be comprised in a composition, preparation, formulation, culture, article of manufacture.

According to some embodiments, the composition, preparation, formulation, culture, article of manufacture, comprises more than 1 microbial strains or species.

According to some embodiments, the composition, preparation, formulation, culture, article of manufacture, comprises 2 microbial strains or species.

According to some embodiments, the composition, preparation, formulation, culture, article of manufacture, comprises 3 microbial strains or species.

According to some embodiments, the composition, preparation, formulation, culture, article of manufacture, comprises 4 microbial strains or species.

According to some embodiments, the composition, preparation, formulation, culture, article of manufacture does not comprise more than 5 different species or strains of microbes.

According to some embodiments, the composition, preparation, formulation, culture, article of manufacture does not comprise more than 4 different species or strains of microbes.

According to some embodiments, the composition, preparation, formulation, culture, article of manufacture does not comprise more than 3 different species or strains of microbes.

According to some embodiments, the composition, preparation, formulation, culture, article of manufacture does not comprise more than 2 different species or strains of microbes.

According to some embodiments of the invention, the composition, preparation, formulation, culture, article of manufacture comprises less than 10 microbial species.

According to some embodiments of the invention, the composition, preparation, formulation, culture, article of manufacture comprises less than 9 microbial species.

According to some embodiments of the invention, the composition, preparation, formulation, culture, article of manufacture comprises less than 8 microbial species.

According to some embodiments of the invention, the composition, preparation, formulation, culture, article of manufacture comprises less than 7 microbial species.

According to some embodiments of the invention, the composition, preparation, formulation, culture, article of manufacture comprises less than 6 microbial species.

According to some embodiments of the invention, the composition, preparation, formulation, culture, article of manufacture comprises less than 5 microbial species.

According to some embodiments of the invention, the composition, preparation, formulation, culture, article of manufacture comprises 4 microbial species.

According to some embodiments of the invention, the composition, preparation, formulation, culture, article of manufacture comprises 3 microbial species.

According to some embodiments of the invention, the composition, preparation, formulation, culture, article of manufacture comprises 2 microbial species.

According to some embodiments of the invention, the composition, preparation, formulation, culture, article of manufacture comprises 3 microbial strains.

According to some embodiments of the invention, the composition, preparation, formulation, culture, article of manufacture comprises 2 microbial strains.

According to a specific embodiment of the invention, the composition, preparation, formulation, culture, article of manufacture comprises a single microbial species i.e., the isolated bacterial stain.

According to a specific embodiment, the composition, preparation, formulation, culture, article of manufacture comprises the bacterial strain at a level of purity of at least about 20%, at least about 30%, at least about 40%, at least about 50%, at least about 60%, at least about 70%, at least about 80%, at least about 85%, at least about 90%, at least about 91%, at least about 92%, at least about 93%, at least about 94%, at least about 95%, 96%, at least about, 97%.

According to a specific embodiment, the composition, preparation, formulation, culture, article of manufacture comprises the bacterial strain at a level of purity of at least about 98%, at least about 99%, at least about 99.1%, at least about 99.2%, at least about 99.3%, at least about 99.4%, at least about 99.5%, at least about 99.6%, at least about 99.7%, at least about 99.8%, at least about 99.9%, at least about 99.95%, at least about 99.99% or more, say 100% pure.

According to a specific embodiment, the microbial strain comprises viable (more than 50%) microbial cells.

As used herein "viable" refers to a microorganism that is alive and capable of regeneration and/or propagation, while in a vegetative, frozen, preserved, or reconstituted state.

According to a specific embodiment, the microbial strain comprises spores of the bacterial strain.

As used herein ""spores" or "endospores" refer to microbes that are generally viable, more resistant to environmental influences such as heat and bactericidal than other forms of the same bacterial species, and typically capable of germination and out-growth. Bacteria that are "capable of forming spores" are those bacteria comprising the genes and other necessary abilities to produce spores under suitable environmental conditions.

As used in herein, the term "CFUs" or "Colony Forming Units" refers to the number of microbial cells e.g., bacterial strain, in a defined sample (e g milliliter of liquid, gram of powder) that form colonies and thereafter numbered, on a semi-solid bacteriological growth medium.

According to specific embodiments, the enrichment in the composition, preparation, formulation, culture, article of manufacture is $10^2$ CFUs-$10^9$ CFUs/gr powder or $10^2$ CFUs-$10^9$ CFUs/ml.

According to specific embodiments, the enrichment in the composition, preparation, formulation, culture, article of manufacture is $10^2$ CFUs-$10^8$ CFUs/gr powder or $10^2$ CFUs-$10^8$ CFUs/ml.

According to specific embodiments, the enrichment in the composition, preparation, formulation, culture, article of manufacture is $10^2$ CFUs-$10^7$ CFUs/gr powder or $10^2$ CFUs-$10^7$ CFUs/ml.

According to specific embodiments, the enrichment in the composition, preparation, formulation, culture, article of manufacture is $10^2$ CFUs-$10^6$ CFUs/gr powder or $10^2$ CFUs-$10^6$ CFUs/ml.

According to specific embodiments, the enrichment in the composition, preparation, formulation, culture, article of According to a specific embodiment, the composition, preparation, formulation, culture, article of manufacture comprises the bacterial strain at a level of purity of $10^2$ CFUs-$10^5$ CFUs/gr powder or $10^2$ CFUs-$10^5$ CFUs/ml.

According to specific embodiments, the enrichment in the composition, preparation, formulation, culture, article of manufacture is $10^2$ CFUs-$10^4$ CFUs/gr powder or $10^2$ CFUs-$10^4$ CFUs/ml.

According to specific embodiments, the enrichment in the composition, preparation, formulation, culture, article of manufacture is $10^2$ CFUs-$10^3$ CFUs/gr powder or $10^2$ CFUs-$10^3$ CFUs/ml.

According to specific embodiments, the enrichment in the composition, preparation, formulation, culture, article of manufacture is $10^3$ CFUs-$10^9$ CFUs/gr powder or $10^3$ CFUs-$10^9$ CFUs/ml.

According to specific embodiments, the enrichment in the composition, preparation, formulation, culture, article of manufacture is $10^4$ CFUs-$10^9$ CFUs/gr powder or $10^4$ CFUs-$10^9$ CFUs/ml.

According to specific embodiments, the enrichment in the composition, preparation, formulation, culture, article of manufacture is $10^5$ CFUs-$10^9$ CFUs/gr powder or $10^5$ CFUs-$10^9$ CFUs/ml.

According to specific embodiments, the enrichment in the composition, preparation, formulation, culture, article of manufacture is $10^6$ CFUs-$10^9$ CFUs/gr powder or $10^6$ CFUs-$10^9$ CFUs/ml.

According to specific embodiments, the enrichment in the composition, preparation, formulation, culture, article of manufacture is $10^7$ CFUs-$10^9$ CFUs/gr powder or $10^7$ CFUs-$10^9$ CFUs/ml.

According to specific embodiments, the enrichment in the composition, preparation, formulation, culture, article of manufacture is $10^8$ CFUs-$10^9$ CFUs/gr powder or $10^8$ CFUs-$10^9$ CFUs/ml.

According to specific embodiments, the enrichment in the composition, preparation, formulation, culture, article of manufacture is $10^8$ CFUs-$10^9$ CFUs/gr powder or $10^8$ CFUs-$10^9$ CFUs/ml.

According to a specific embodiment the composition, preparation, formulation, culture, article of manufacture comprises at least about 100 CFUs or spores, at least about $10^2$ CFUs/gr or CFUs/ml, at least about $10^2$ CFUs/gr or CFUs/ml, at least about $10^3$ CFUs/gr or CFUs/ml, at least about $10^4$ CFUs/gr or CFUs/ml, at least about $10^5$ CFUs/gr or CFUs/ml, at least about $10^6$ CFUs/gr or CFUs/ml, at least about $10^7$ CFUs/gr or CFUs/ml, at least about $10^8$ CFUs/gr or CFUs/ml, at least about $10^9$ CFUs/gr or CFUs/ml, at least about $10^{10}$ CFUs/gr or CFUs/ml, at least about $10^{11}$ CFUs/gr or CFUs/ml, at least about $10^{12}$ CFUs/gr or CFUs/ml.

According to a specific embodiment the composition, preparation, formulation, culture, article of manufacture (especially for a liquid formulation) comprises at least about $10^6$ CFUs/gr or CFUs/ml, at least about $10^7$ CFUs/gr or CFUs/ml, at least about $10^8$ CFUs/gr or CFUs/ml, at least about $10^9$ CFUs/gr or CFUs/ml.

According to a specific embodiment the composition, preparation, formulation, culture, article of manufacture (especially for a dry formulation) comprises at least about $10^8$ CFUs/gr or CFUs/ml, at least about $10^9$ CFUs/gr or CFUs/ml, at least about $10^{10}$ CFUs/gr or CFUs/ml, at least about $10^{11}$ CFUs/gr or CFUs/ml, at least about $10^{12}$ CFUs/gr or CFUs/ml.

According to a specific embodiment, the composition, preparation, formulation, culture, article of manufacture is selected from the group consisting of a still culture, whole cultures stored stock of cells (particularly glycerol stocks), agar strip, stored agar plug in glycerol/water, freeze dried stock, and dried stocks such as lyophilisate dried onto filter paper.

According to a specific embodiment, the composition, preparation, culture or formulation is devoid of animal contaminants to render it safe for human use.

As used herein "a culture" refers to a fluid, pellet, scraping, dried sample, lyophilisate or a support, container, or medium such as a plate, paper, filter, matrix, straw, pipette or pipette tip, fiber, needle, gel, swab, tube, vial, particle, etc. that contains the deposited strain or the functional homolog thereof in an amount that exceeds that found in nature, as described hereinabove. In the present invention, an isolated culture of a microbial strain is a culture fluid or a scraping, pellet, dried composition, preparation, formulation, culture, article of manufacture, lyophilisate, or a support, container, or medium that contains the microorganism, in the absence of other organisms (or in combination with other microbes which were preselected and grown for the purpose of combined administration).

According to a specific embodiment, the bacterial strain within the composition, preparation, formulation, culture, article of manufacture is viable.

The bacterial strain can be produced or manufactured using methods which are well known in the art of microbiology.

According to a specific embodiment, the microbial strain is isolated from Doenjang, such as by using Luria Bertani Miller agar (BD, Difco) agar for plating. According to a specific embodiment, representative colonies are picked from plates with the highest dilution still showing colonies.

After purification, the strain was stored at −80° C. The stock culture is propagated in LB Miller broth.

According to an aspect, the bacterial strain is cultured under conditions that allow propagation; after which (and/or during which) the bacterial strain is harvested.

Thus, according to some embodiments, cultures of the microbial strain may be prepared using standard static drying and liquid fermentation techniques known in the art. Growth is commonly effected in a bioreactor.

A bioreactor refers to any device or system that supports a biologically active environment. As described herein a bioreactor is a vessel in which microorganisms including the microorganism of the invention can be grown. A bioreactor may be any appropriate shape or size for growing the microorganisms. A bioreactor may range in size and scale from 10 mL (e.g., small scale) to liter's to cubic meters (e.g., large scale) and may be made of stainless steel, disposable material (e.g., nylon, plastic bags) or any other appropriate material as known and used in the art. The bioreactor may be a batch type bioreactor, a fed batch type or a continuous-type bioreactor (e.g., a continuous stirred reactor). For example, a bioreactor may be a chemostat as known and used in the art of microbiology for growing and harvesting microorganisms. A bioreactor may be obtained from any commercial supplier (See also Bioreactor System Design, Asenjo & Merchuk, CRC Press, 1995).

For small scale operations, a batch bioreactor may be used, for example, to test and develop new processes, and for processes that cannot be converted to continuous operations.

Microorganisms grown in a bioreactor may be suspended or immobilized. Growth in the bioreactor is generally under aerobic conditions at suitable temperatures and pH for growth. For the organisms of the invention, cell growth can be achieved at temperatures between 5-40° C., with an exemplary temperature range selected from 20 to 10° C., 15 to 28° C., 20 to 30° C., or 15 to 25° C. The pH of the nutrient medium can vary between 4.0 and 9.0. For example, the operating range can be usually slightly acidic to neutral at pH 5.0 to 8.5, or 4.5 to 6.5, or pH 5.0 to 6.0.

According to a specific embodiment, the cell growth is achieved at 20-40° C. at pH of 5.0-8.5.

Typically, maximal cell yield is obtained in 20-72 hours after inoculation. By virtue of the conditions applied in the selection process and general requirements of most microorganisms, a person of ordinary skill in the art would be able to determine essential nutrients and conditions. The microorganisms would typically be grown in aerobic liquid cultures on media which contain sources of carbon, nitrogen, and inorganic salts that can be assimilated by the microorganism and supportive of efficient cell growth. Exemplary carbon sources are hexoses such as glucose, but other sources that are readily assimilated such as amino acids, may be substituted. Many inorganic and proteinaceous materials may be used as nitrogen sources in the growth process. Exemplary nitrogen sources are amino acids and urea but others include gaseous ammonia, inorganic salts of nitrate and ammonium, vitamins, purines, pyrimidines, yeast extract, beef extract, proteose peptone, soybean meal, hydrolysates of casein, distiller's solubles, and the like. Among the inorganic minerals that can be incorporated into the nutrient medium are the customary salts capable of yielding calcium, zinc, iron, manganese, magnesium, copper, cobalt, potassium, sodium, molybdate, phosphate, sulfate, chloride, borate, and like ions.

The culture can be a pure culture, whereby a single microbial strain is included or a mixed culture. This is of course pending the compliance of the microbial strains to co-exist and proliferate under the same culturing conditions. When needed, an antibiotic or other growth-restricting conditions can be employed during culturing to restrict the growth of other microorganisms (contaminants) not desired in the culture/co-culture e.g., temperature, essential nutrients and the like.

According to an alternative or an additional embodiment, the desired combination is produced following culturing, such as when the microbial strains do not share the same or optimal culturing conditions.

The ratio of each type of microorganism in the final product will depend on the intended use (some are listed hereinbelow).

According to a specific embodiment the ration between the B. amyloliquefaciens 298, B. subtilis 3 and B. subtilis 281 strains is 10:1:1.

According to a specific embodiment the ration between the B. amyloliquefaciens 298, B. subtilis 3 and B. subtilis 281 strains is 1:1:10.

According to a specific embodiment the ration between the B. amyloliquefaciens 298, B. subtilis 3 and B. subtilis 281 strains is 1:10:1.

According to a specific embodiment the ration between the B. amyloliquefaciens 298, B. subtilis 3 and B. subtilis 281 strains is 1:10:10.

According to a specific embodiment the ration between the B. amyloliquefaciens 298, B. subtilis 3 and B. subtilis 281 strains is 10:10:1.

According to a specific embodiment the ration between the B. amyloliquefaciens 298, B. subtilis 3 and B. subtilis 281 strains is 10:1:10.

According to a specific embodiment the ration between the B. amyloliquefaciens 298, B. subtilis 3 and B. subtilis 281 strains is 5:1:1.

According to a specific embodiment the ration between the B. amyloliquefaciens 298, B. subtilis 3 and B. subtilis 281 strains is 1:1:5.

According to a specific embodiment the ration between the B. amyloliquefaciens 298, B. subtilis 3 and B. subtilis 281 strains is 1:5:1.

According to a specific embodiment the ration between the B. amyloliquefaciens 298, B. subtilis 3 and B. subtilis 281 strains is 1:5:5.

According to a specific embodiment the ration between the B. amyloliquefaciens 298, B. subtilis 3 and B. subtilis 281 strains is 5:5:1.

According to a specific embodiment the ration between the B. amyloliquefaciens 298, B. subtilis 3 and B. subtilis 281 strains is 5:1:5.

According to a specific embodiment the ration between the B. amyloliquefaciens 298, B. subtilis 3 and B. subtilis 281 strains is 2:1:1.

According to a specific embodiment the ration between the B. amyloliquefaciens 298, B. subtilis 3 and B. subtilis 281 strains is 1:1:2.

According to a specific embodiment the ration between the B. amyloliquefaciens 298, B. subtilis 3 and B. subtilis 281 strains is 1:2:1.

According to a specific embodiment the ration between the B. amyloliquefaciens 298, B. subtilis 3 and B. subtilis 281 strains is 1:2:2.

According to a specific embodiment the ration between the B. amyloliquefaciens 298, B. subtilis 3 and B. subtilis 281 strains is 2:2:1.

According to a specific embodiment the ration between the *B. amyloliquefaciens* 298, *B. subtilis* 3 and *B. subtilis* 281 strains is 2:1:2.

According to a specific embodiment the ration between the *B. amyloliquefaciens* 298, *B. subtilis* 3 and *B. subtilis* 281 strains is 1:1:1.

The identity of the microorganism(s) in the culture can be experimentally validated at the nucleic acid level, protein level, metabolite levels, functional level and/or by using classical microbiology tools, e.g., streaking (e.g., with selection).

After production, the microbial strain can be stored or used fresh, either as is or subject to further formulation.

Also contemplated herein are a lysate and/or a fermentation product of the above described methods. Methods of cell lysis of bacterial strains e.g., of the species *B. amyloliquefaciens* are well known in the art.

The formulation of the microbial strain much depends on the intended use. Following is a non-limiting description of various formulations that can be used along with the present teachings.

According to a specific embodiment, the bacterial strain is formulated in a liquid formulation.

According to a specific embodiment, the bacterial strain is formulated in a dry formulation.

According to a specific embodiment, the bacterial strain is formulated in a gel formulation.

Microbial strains formulations used to reduce the incidence of pathogenic microorganisms (bacteria and/or fungi), can be in vivo administered, can be released into the air or in conjunction with an HVAC system, applied to waste, food products, food processing areas, food preparation tools, agricultural products, agricultural water (irrigation water, agricultural soils, agricultural crops) and the like. The formulations of bacteria described herein can be applied in a powder, liquid, foam, gelled, aerosol or solid form. In liquid formulations, the microbial strain formulations may be dispensed from conventional dispensing devices, including pump sprayers, aerosol containers, squirt bottles etc. For application over larger areas, hoses, sprinkler systems or other suitable devices may be used. In the alternative, the formulations can be applied as a dry powder such as lyophilized bacteria or using any of the techniques currently known to a person of skill in the art. The optimal frequency of applications of the microbial strain formulations may depend on the target on which the formulation is to be applied. In certain embodiments, wherein formulations are contemplated, a microorganism is harvested and concentrated using a method that does not markedly decrease the viable cell concentration through centrifugation or filtration.

In embodiments wherein formulations are contemplated for preservation, such preservation may include a process of freezing, freeze-drying and/or spray-drying.

In certain embodiments, the preserved cells can be used in a microbial-based product. The preserved bacterial strain can be provided "as-is" without further dilution or modification. Additionally, in certain embodiments, the bacterial strain can be mixed with a carrier to dilute the concentration of cells to an appropriate concentration for administration. The carrier can be as simple as one element, or a more complex molecule or mixture of molecules in any proportion in order to act as a suitable carrier. This carrier and composition may, in certain instances, have defined properties such as solubility in water or other media. The diluting carrier can be of any composition or combination including but not limited to: lactose, glucose, non-fat dry milk powder, oligosaccharides, glycerol, oil, lecithin, or other materials.

In particular formulations, other chemicals or materials may be used to reduce or absorb moisture and/or oxygen for further protection and preservation of the viable microbial cells. Such chemicals or materials include, but are not limited to: calcium stearate, sodium aluminosilicate, sodium sulfide, sodium carbonate, silica, iron oxides, calcium carbonate, zeolite, bicarbonates, sodium sulfate, silicon dioxide and other silica materials.

In certain embodiments, a microbial strain formulation for administration to a subject or a surface or other target can include a preservation matrix, which contains and preserves the culture. Such a matrix may include a biologically active binding agent, an antioxidant, a polyol, a carbohydrate and a proteinaceous material.

Antioxidants included in a preservation matrix may be provided to retard oxidative damage to the microbial cells during the preservation and storage process.

Polyols (i.e., polyhydric alcohols) included in a preservation matrix may be provided to maintain the native, uncollapsed state of cellular proteins and membranes during the preservation and storage process. In particular, polyols interact with the cell membrane and provide support during the dehydration portion of the preservation process. Examples of polyols include, but are not limited to xylitol, adonitol, glycerol, dulcitol, inositol, mannitol, sorbitol and/or arabitol.

Carbohydrates included in a preservation matrix may be provided to maintain the native, uncollapsed state of cellular proteins and membranes during the preservation and storage process. In particular, carbohydrates provide cell wall integrity during the dehydration portion of the preservation process. Exemplary carbohydrates include, but are not limited to dextrose, lactose, maltose, sucrose, fructose and/or any other monosaccharide, disaccharide or polysaccharide.

A proteinaceous material included in a preservation matrix may provide further protection of the microbial cell during the dehydration portion of the preservation process. Exemplary proteinaceous materials include, but are not limited to skim milk and albumin.

The microbial cells can be preserved within a preservation matrix including coating the cell matrix suspension onto an inert carrier e.g., a maltodextrin bead. The coated beads can then be dried, e.g., by a fluid bed drying method. Fluid bed drying methods are well known in the art. The coated beads can be stored as a powder, placed into gelatin capsules, or pressed into tablets.

In other formulations, the microbial strain contemplated can be formulated as a hard gelatin capsule. Gelatin capsules are commercially available and are well known in the art. In this embodiment, the method further comprises dispensing the cell suspension matrix to a gelatin capsule, chilling the gelatin capsule until the cell suspension matrix forms a non-fluid matrix and to affix the gel to the interior wall of the gelatin capsule, and desiccating the gelatin capsule in a desiccation chamber. Further examples of embodiments of preservation matrices and gelatin capsule formulations may be found in U.S. Pat. No. 6,468,526 which is herein incorporated by reference in its entirety.

In certain applications, the microbial strain may be placed in a microencapsulation formulation. Such microencapsulation formulations may have applicability for example in administration to subjects via oral, nasal, rectal, vaginal or urethral routes. Spray drying is the most commonly used microencapsulation method in the food industry, is economical and flexible, and produces a good quality product. The process involves the dispersion of the core material into a polymer solution, forming an emulsion or dispersion, followed by homogenisation of the liquid, then atomisation of the mixture into the drying chamber. This leads to evaporation of the solvent (water) and hence the formation of matrix type microcapsules.

Examples of microencapsulation can be found for example in U.S. Pat. No. 5,641,209 that is herein incorporated by reference.

An embodiment of preserving by freezing is to prepare frozen beads or pellets comprising the microbial strain. After a suitable fermentation, the liquid is removed from the viable bacteria by a method including but not limited to centrifugation, ultrafiltration, or sedimentation. An additive compound may be added to the bacteria prior to freezing. Suitable additives include but are not limited to, lactose, sucrose, trehalose, maltodextrin, cyclodextrin, spray gum, fish gelatin bloom, and maltitol.

Suitable additives may also serve as cryoprotective agents to improve the stability of the frozen culture. Cryoprotective agents include, but are not limited to, proteins, protein hydrosolates, carbohydrates, or a compound involved in the biosynthesis of nucleic acids. U.S. Publ. Appl. 20070254353. Proteins or protein hydrolysates include but are not limited to, malt extract, milk powder, whey powder, yeast extract, gluten, collagen, gelatin, elastin, keratin, or albumin. Carbohydrates include but are not limited to pentoses (e.g. ribose, xylose), hexoses (e.g. fructose, mannose, sorbose), disaccharides (e.g. sucrose, trehalose, melibiose, lactulose), oligosaccharides (e.g. raffinose), oligofrutoses (e.g. actilight, fribroloses), polysaccharides (e.g. maltodextrins, xanthan gum, pectin, alginate, microcrystalline cellulose, dextran, PEG), and sugar alcohols (sorbitol, manitol). U.S. Publ. Appl. 20070254353.

A foam is defined herein is a composition that is formed by trapping many gas bubbles in a liquid. Methods pertaining to the formulation and administration of foams are set forth in U.S. Pat. Nos. 4,112,942, 5,652,194, 6,140,355, 6,258,374, and 6,558,043, each of which is herein specifically incorporated by reference in its entirety.

A typical foam formulation may, for example, be constructed by introducing a gas into a gel or aqueous pharmaceutical composition such that bubbles of the gas are within the pharmaceutical composition.

A microbial strain formulation can be applied to a surface or simply to the air using an electrostatic spray apparatus. This apparatus should have a chamber for containing the microbial strain formulation and an opening in fluid connection with the chamber through which the microbial strain formulation can be dispensed and deposited on a desired surface. The apparatus should allow for electrically charging the microbial strain formulation. For example, a conductor can be used to connect the chamber to a voltage power source. One of skill in the art would be aware of other suitable devices that can function as such a conductor.

To apply the formulation to a surface or to the air, the formulation is placed into the chamber of the electrostatic spray apparatus. The microbial strain formulation can be pumped into the chamber. When the microbial strain formulation is placed into the chamber, it contacts the conductor, such as a high-voltage DC electrode, and becomes charged. Once the formulation in the chamber is charged, it carries the same charge as the conductor. As a result the formulation and conductor repel each other. This repulsive force discharges the microbial strain formulation through the opening of the nozzle to create streams of droplets. Therefore, no additional gas source is required for atomization of the coating formulation. Accordingly, a cloud of highly charged, highly uniform-sized droplets can be formed.

Since the droplets that are formed carry a charge, when they are deposited on a grounded surface, they will be guided by their electrostatic attraction to the grounded and hence electrically neutral surface. Since the droplets carry the same electrical charge, they will repel each other. This repulsion causes the droplets arriving at the surface to avoid the areas where other droplets have already been deposited and instead land on areas of the surface that have not been coated. In this way, an inherently uniform coating is formed.

One example of a suitable nozzle apparatus that can be used in the method of some embodiments of the invention is an apparatus for electrohydrodynamic spray-coating that is disclosed in U.S. Pat. No. 4,749,125. This apparatus has a metal shim that is placed within the nozzle apparatus to define a plurality of nozzle openings. The metal shim is also connected to a voltage source that allows for the formation of electrically charged droplets of coating formulation. Aerosol dispending system and automated embodiments thereof are further described hereinbelow.

Lyophilization—Dry microorganism cultures may be prepared according to methods which are well known in the art. In addition to constituents present in the culture medium, the medium may comprise at least one matrix material with or without other stabilizing substances. These materials may be selected from inorganic salts or buffers, at least one other compound which is selected from mono-, oligo- and polysaccharides, polyols, polyethers, amino acids, oligo- and polypeptides, milk-derived compounds, organic carboxylic acids, mineral compounds, organic carrier materials such as wheat semolina bran, alginates, DMSO, PVP (polyvinylpyrrolidone), CMC (carboxymethylcellulose), alpha-tocopherol, beta.-carotene and mixtures thereof.

Examples of suitable saccharide carrier components are sucrose, fructose, maltose, dextrose, lactose and maltodextrin. An example of a suitable polyol is glycerol. Examples of suitable amino acids are glutamic acid, aspartic acid and the salts thereof. An example of a suitable peptide carrier is peptone. An example of a milk-derived compound is sweet whey powder. Suitable organic carboxylic acids are, for example, citric acid, malic acid and L-ascorbic acid. Examples of suitable mineral carriers are montmorillonite and palygorskite.

The microorganism suspension containing the carrier can be dried in various ways. Suitable drying processes are in principle freeze drying, fluidized-bed drying and, spray-drying. Spray-drying also comprises modified spray-drying processes, such as spray-agglomeration or agglomerating spray-drying. The latter process is also known under the name FSD (fluidized spray-dryer) process.

Freeze-drying for preparing dry microorganism cultures according to some embodiments of the present invention can be carried out, for example, on the basis of the freeze-drying process described in U.S. Pat. No. 3,897,307, the contents of which is incorporated completely by reference.

Another drying process contemplated for use according to some embodiments of the present invention is spray-drying. Those methods which can be used according to some embodiments of the present invention are essentially all spray-drying techniques known in the art. The material to be sprayed can, for example, be dried concurrently or countercurrently; spraying can be carried out by means of a single-component or multiple-component nozzle or by means of an atomizer wheel.

The drying process according to some embodiments of the present invention may be carried out in such a manner that a very low residual moisture content is present in the dry material. The percentage water content is typically from about 2 to 3% by weight. This may be achieved by adding a post-drying step subsequently to the spray-drying step. The drying material is, for example, post-dried in a fluidized bed, such as at a temperature in the range of from 15 to 50° C., for a period of, for example, from 15 minutes to 20 hours. Conditioned compressed air or conditioned nitrogen serves as drying gas.

Instead of the above-described physical post-drying processes, it is also conceivable to add specific desiccants to the dry material obtained from the spray-drying. Examples of suitable desiccants are inorganic salts, such as calcium chloride and sodium carbonate, organic polymers, such as the product obtainable under the trade name Kollidion 90 F, and silicon-dioxide-containing desiccants, such as silica gel, zeolites and desiccants which are obtainable under the trade name Tixosil 38, Sipernat 22 S or Aerosil 200.

In certain embodiments, the microbial; strain may be refrigerated after harvesting and concentrating. In certain embodiments, after a suitable fermentation, the liquid is removed from the viable bacteria by a method including but not limited to centrifugation, ultrafiltration, or sedimentation. An additive compound may be added to the bacteria prior to refrigeration. Suitable additives include but are not limited to, lactose, sucrose, trehalose, maltodextrin, cyclodextrin, spray gum, fish gelatin bloom, and maltitol.

Suitable additives may also serve as cryoprotective agents to improve the stability of the refrigerated culture. Cryoprotective agents include, but are not limited to, proteins, protein hydrolosates, carbohydrates, or a compound involved in the biosynthesis of nucleic acids. U.S. Publ. Appl. 20070254353. Proteins or protein hydrolysates include but are not limited to, malt extract, milk powder, whey powder, yeast extract, gluten, collagen, gelatin, elastin, keratin, or albumin. Carbohydrates include but are not limited to pentoses (e.g. ribose, xylose), hexoses (e.g. fructose, mannose, sorbose), disaccharides (e.g. sucrose, trehalose, melibiose, lactulose), oligosaccharides (e.g. raffinose), oligofrutoses (e.g. actilight, fribroloses), polysaccharides (e.g. maltodextrins, xanthan gum, pectin, alginate, microcrystalline cellulose, dextran, PEG), and sugar alcohols (sorbitol, manitol). U.S. Publ. Appl. 20070254353.

The type of formulation depends on the intended use.

It will be appreciated that the present inventors have identified for the first time certain activities of the bacterial strain *Bacillus amyloliquefaciens*. This bacterial strain was found effective and safe for use in the treatment of respiratory tract infections.

As used herein, the term "treating" includes abrogating, substantially inhibiting, slowing or reversing the progression of a condition, substantially ameliorating clinical or other symptoms of a condition or substantially preventing the appearance of clinical or other symptoms of a condition.

Thus, according to an aspect of the invention there is provided a method of controlling a population of pathogenic bacteria and/or fungi in a respiratory system, the method comprising administering to a subject in need thereof an effective amount of bacteria of the species *Bacillus amyloliquefaciens* or any composition comprising same such as described herein, thereby controlling the population of pathogenic bacteria and/or fungi in the respiratory system.

As used herein "*Bacillus amyloliquefaciens*" refers to a bacterial species in the genus *Bacillus*. It is a gram positive soil bacteria closely related to the species *Bacillus subtilis*. According to a specific embodiment strains of this bacterial species are as described herein, e.g., *Bacillus amyloliquefaciens* 298 and functional homologs thereof.

According to an aspect of the invention there is provided a method of controlling a population of pathogenic bacteria and/or fungi, the method comprising providing an effective amount of the isolated bacterial strain or functional homolog of same or the composition such as described herein, thereby controlling the population of pathogenic bacteria and/or fungi.

As used herein "controlling" refers to preventing or reducing microbial infections such as a bacterial or fungal infection or inhibiting the rate and extent of such infection. Therapeutic treatment is also contemplated.

According to a specific embodiment, the controlling is prevention of an infection.

As described hereinbelow, the present inventors identified the use of the bacterial strain as described herein in controlling various species of microbes.

Thus, according to some embodiments, the present compositions and methods are useful in controlling *E. coli*.

*Escherichia coli* is a Gram-negative, facultatively anaerobic, rod-shaped, coliform bacterium of the genus *Escherichia* that is commonly found in the lower intestine of warm-blooded organisms. Some *E. coli* serotypes can cause serious food poisoning in their hosts, and are occasionally responsible for product recalls due to food contamination. It is most abundant in food and water supply and industrial sites (e.g., paper production).

According to some additional or alternative embodiments, the present compositions and methods are useful in controlling *Pseudomonas aeruginosa*.

*Pseudomonas aeruginosa* is a common Gram-negative, rod-shaped bacterium that can cause disease in plants and animals, including humans. It is the most common cause of infections of burn injuries and of the outer ear (otitis externa), and is the most frequent colonizer of medical devices (e.g., catheters). *Pseudomonas* can be spread by equipment that gets contaminated and is not properly cleaned or on the hands of healthcare workers. *Pseudomonas* can cause community-acquired pneumonias, as well as ventilator-associated pneumonias, being one of the most common agents isolated in several studies. One in ten hospital-acquired infections is from *Pseudomonas*. Cystic fibrosis patients are also predisposed to *P. aeruginosa* infection of the lungs. *P. aeruginosa* may also be a common cause of "hot-tub rash" (dermatitis), caused by lack of proper, periodic attention to water quality. Since these bacteria like moist environments, such as hot tubs and swimming pools, they can cause skin rash or swimmer's ear. *Pseudomonas* is also a common cause of postoperative infection in radial keratotomy surgery patients. The organism is also associated with the skin lesion ecthyma gangrenosum. *P. aeruginosa* is frequently associated with osteomyelitis involving puncture wounds of the foot, believed to result from direct inoculation with *P. aeruginosa* via the foam padding found in tennis shoes, with diabetic patients at a higher risk.

According to some additional or alternative embodiments, the present compositions and methods are useful in controlling *Bacillus cereus*.

*Bacillus cereus* is a Gram-positive, rod-shaped, aerobic, facultatively anaerobic, motile, beta hemolytic bacterium commonly found in soil and food. Some strains are harmful to humans and cause foodborne disease. *Bacillus* foodborne diseases occur due to survival of the bacterial endospores when food is improperly cooked. Cooking temperatures less than or equal to 100° C. (212° F.) allow some *B. cereus* spores to survive. This problem is compounded when food is then improperly refrigerated, allowing the endospores to germinate.

According to some additional or alternative embodiments, the present compositions and methods are useful in controlling *Staphylococcus aureus*.

*Staphylococcus aureus* is a Gram-positive, round-shaped bacterium that is a member of the Firmicutes, and it is a member of the normal flora of the body, frequently found in the nose, respiratory tract, and on the skin. It is often positive for catalase and nitrate reduction and is a facultative anaerobe that can grow without the need for oxygen. It is a common cause of skin infections including abscesses, respiratory infections such as sinusitis, and food poisoning. Pathogenic strains often promote infections by producing virulence factors such as potent protein toxins, and the expression of a cell-surface protein that binds and inactivates antibodies. The emergence of antibiotic-resistant strains of *S. aureus* such as methicillin-resistant *S. aureus* (MRSA) is a worldwide problem in clinical medicine. Despite much research and development there is no approved vaccine for *S. aureus*. Spread of *S. aureus* (including MRSA) generally is through human-to-human contact, although recently some veterinarians have discovered the infection can be spread through pets. Recently, myriad cases of *S. aureus* have been reported in hospitals across America. Transmission of the pathogen is facilitated in medical settings where healthcare worker hygiene is insufficient. *S. aureus* is an incredibly hardy bacterium, as was shown in a study where it survived on polyester for just under three months; polyester is the main material used in hospital privacy curtains. The bacteria are transported on the hands of healthcare workers, who may pick them up from a seemingly healthy patient carrying a benign or commensal strain of *S. aureus*, and then pass it on to the next patient being treated. Introduction of the bacteria into the bloodstream can lead to various complications, including endocarditis, meningitis, and, if it is widespread, sepsis.

According to some additional or alternative embodiments, the present compositions and methods are useful in controlling *Salmonella typhimurium*.

*Salmonella typhimurium*. is a serogroup of a rod-shaped, flagellated, facultative anaerobic, Gram-negative bacterium and a member of the genus *Salmonella*. It is a serovar that is a serious human pathogen. The encounter of humans to *S. typhimurium* is made via fecal-oral route from infected individuals or animals to healthy ones, with food as a common vector. Poor hygiene of patients shedding the organism can lead to secondary infection, as well as consumption of shellfish from polluted bodies of water. Most common source of infection, however, are food of animal origin and drinking water tainted by urine and feces of infected individuals and animals.

According to some additional or alternative embodiments, the present compositions and methods are useful in controlling *Alternaria alternata*.

*Alternaria alternata* is a fungus which has been recorded causing leaf spot and other diseases on over 380 host species of plant. It is an opportunistic pathogen on numerous hosts causing leaf spots, rots and blights on many plant parts. In order to survive, *Alternaria alternata* needs a moist warm environment. It is often found in areas with humid climates, or where there has been significant rainfall. The fungus lives in seeds and seedlings, and is also spread by spores. This disease flourishes in dead plants that have been left in gardens over winter. Additionally, when dead infected debris is added to compost pile it can spread to other vegetables throughout the garden.

According to some additional or alternative embodiments, the present compositions and methods are useful in controlling *Cladosporium sphaerospermum*.

*Cladosporium sphaerospermum* is a fungus belonging to the genus *Cladosporium*. *Cladosporium sphaerospermum* is mainly known as a spoilage agent of harvested fruits and vegetables. *Cladosporium sphaerospermum* is a cosmopolitan fungus that inhabits city buildings and the environment and because of its airborne nature it can move rapidly between locations. *Cladosporium sphaerospermum* is also been shown to inhabit paint films on walls and other surfaces as well as old paintings. This fungus is also able to grow on gypsum-based material with and without paint and wallpaper. Plant materials that are affected include citrus leaves on various other decaying plant leaves, on the stems of herbaceous and woody plants, on fruits and vegetables. The fungus has also been reported from wheat-based bakery items.

According to some additional or alternative embodiments, the pathogenic bacteria and/or fungi are airborne pathogens that typically cause inflammation in the respiratory system e.g., nose, throat, sinuses and the lungs.

Examples of severe infections caused by airborne bacteria include, but are not limited to tuberculosis, pneumonia, and legionellosis.

As mentioned, according to some embodiments, the methods described herein are directed to controlling a population of pathogenic bacteria and/or fungi in a respiratory system which may cause a respiratory tract disease.

For administration by nasal inhalation, the active ingredients for use according to some embodiments of the invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in a dispenser may be formulated containing a powder mix of the compound and a suitable powder base such as lactose or starch.

In one embodiment, the composition according to the present invention may be administered in an aerosol, for example by way of a nasal spray, for instance for administration to the respiratory tract.

As used herein the term “respiratory tract disease” refers to diseases of the upper and/or lower respiratory tracts. The term disease as used herein is synonymous with the term disorder.

In one embodiment the respiratory tract disease is an upper respiratory tract disease.

Upper respiratory tract diseases include, for example, one or more of throat soreness, sneezing, blocked nose, runny nose or a cough is a symptom of one or more of the group consisting of: tonsillitis, otitis media rhinitis (inflammation of the nasal mucosa); rhinosinusitis or sinusitis (inflammation of the nares and paranasal sinuses, including frontal, ethmoid, maxillary, and sphenoid); nasopharyngitis, rhinopharyngitis or the common cold (inflammation of the nares, pharynx, hypopharynx, uvula, and tonsils); pharyngitis (inflammation of the pharynx, hypopharynx, uvula, and tonsils); epiglottitis or supraglottitis (inflammation of the superior portion of the larynx and upraglottic area); laryngitis (inflammation of the larynx); laryngotracheitis (inflammation of the larynx, trachea, and subglottic area); and tracheitis (inflammation of the trachea and subglottic area).

In one embodiment the respiratory tract disease is a lower respiratory tract disease.

Lower respiratory tract diseases include, for example, bronchitis, acute bronchitis, pneumonia, lung abscesses.

According to some embodiments, the present teachings are directed at controlling pathogenic microbes which include, but are not limited to, *Salmonella Typhimurium, Salmonella enterica, Salmonella enteritidis, Clostridium botulinum, Staphylococcus aureus, Campylobacter jejuni, Yersinia enterocolitica* and *Yersinia pseudotuberculosis, Vibrio cholerae* O1, *Vibrio cholerae* non-O1, *Vibrio parahaemolyticus* and other *Vibrio* spp., *Vibrio vulnificus, Clostridium perfringens, Bacillus cereus, Aeromonas hydrophila, Plesiomonas shigelloides, Shigella* spp., miscellaneous enteric pathogens, and *Streptococcus* spp.

According to some embodiments the diseases caused by the pathogenic microbes include, but are not limited to, staphylococcal infections (caused, for example, by *Staphylococcus aureus, Staphylococcus epidermidis,* or *Staphylococcus saprophyticus*), streptococcal infections (caused, for example, by *Streptococcus pyogenes, Streptococcus pneumoniae,* or *Streptococcus agalactiae*), enterococcal infections (caused, for example, by *Enterococcus faecalis*) diphtheria (caused, for example, by *Corynebacterium diptheriae*), anthrax (caused, for example, by *Bacillus anthracis*), listeriosis, gangrene (caused, for example, by *Clostridium perfringens*), tetanus (caused, for example, by *Clostridium tetani*), botulism (caused, for example, by *Clostridium botulinum*), toxic enterocolitis (caused, for example, by *Clostridium difficile*), bacterial meningitis (caused, for example, by *Neisseria meningitidis*), bacteremia (caused, for example, by *Neisseria gonorrhoeae*), *E. coli* infections (colibacilliocis), including urinary tract infections and intestinal infections, shigellosis (caused, for example, by *Shigella* species), *salmonellosis* (caused, for example, by *Salmonella* species), *yersinia* infections (caused, for example, by *Yersinia pestis, Yersinia pseudotuberculosis,* or *Yersinia enterocolitica*), cholera (caused, for example, by *Vibrio cholerae*), campylobacteriosis (caused, for example, by *Campylobacter jejuni* or *Campylobacter fetus*), gastritis (caused, for example, by *Helicobacter pylori*), *pseudomonas* infections (caused, for example, by *Pseudomonas aeruginosa* or *Pseudomonas mallei*), *Haemophilus influenzae* type B (HIB) meningitis, HIB acute epiglottitis, or HIB cellulitis (caused, for example, by *Haemophilus influenzae*), pertussis (caused, for example, by *Bordetella pertussis*), *mycoplasma* pneumonia (caused, for example, by *Mycoplasma pneumoniae*), nongonococcal urethritis (caused, for example, by *Ureaplasma urealyticum*), legionellosis (caused, for example, by *Legionella pneumophila*), syphillis (caused, for example, by *Treponema pallidum*), leptospirosis (caused, for example, by Leptospira interrogans), Lyme borreliosis (caused, for example, by *Borrelia burgdorferi*), tuberculosis (caused, for example, by *Mycobacterium tuberculosis*), leprosy (caused, for example, by *Mycobacterium leprae*), actinomycosis (caused, for example, by *Actinomyces* species), nocardiosis (caused, for example, by *Nocardia* species), *chlamydia* (caused, for example, by *Chlamydia psittaci, Chlamydia trachomatis,* or *Chlamydia pneumoniae*), Rickettsial diseases, including spotted fever (caused, for example, by *Rickettsia* rickesii) and Rickettsial pox (caused, for example, by *Rickettsia akari*), typhus (caused, for example, by *Rickettsia prowazekii*), brucellosis (caused, for example, by *Brucella abortus, Brucella melitens,* or *Brucella suis*), and tularemia (caused, for example, by *Francisella tularensis*). Diseases with similar origins and symptoms are also known to affect animals.

According to a specific embodiment, the controlling is prophylactic (reduces the incidence of infection).

According to a specific embodiment, the controlling is therapeutic (reduces the symptoms and/or duration of infection).

The bacterial strains/species can be administered to subjects in need thereof using methods which are well known in the art.

When used as a medicament, the bacterial strains/species of the present invention may be used in any suitable form—whether when alone or when present in a combination with other components or ingredients.

The microorganism of the present invention or composition of the present invention may be used in the form of solid or liquid preparations or alternatives thereof. Examples of solid preparations include, but are not limited to tablets, capsules, dusts, granules and powders which may be wettable, spray-dried or freeze-dried. Examples of liquid preparations include, but are not limited to, aqueous, organic or aqueous-organic solutions, suspensions and emulsions.

Suitable examples of forms include one or more of: tablets, pills, capsules, ovules, solutions or suspensions, which may contain flavouring or colouring agents, for immediate-, delayed-, modified-, sustained-, pulsed- or controlled-release applications.

By way of example, if the composition of the present invention is used in a tablet form—such for use as a functional ingredient—the tablets may also contain one or more of: excipients such as microcrystalline cellulose, lactose, sodium citrate, calcium carbonate, dibasic calcium phosphate and glycine; disintegrants such as starch (preferably corn, potato or tapioca starch), sodium starch glycollate, croscarmellose sodium and certain complex silicates; granulation binders such as polyvinylpyrrolidone, hydroxypropylmethylcellulose (HPMC), hydroxypropylcellulose (HPC), sucrose, gelatin and acacia; lubricating agents such as magnesium stearate, stearic acid, glyceryl behenate and talc may be included.

Examples of nutritionally acceptable carriers for use in preparing the forms include, for example, water, salt solutions, alcohol, silicone, waxes, petroleum jelly, vegetable oils, polyethylene glycols, propylene glycol, liposomes, sugars, gelatin, lactose, amylose, magnesium stearate, talc, surfactants, silicic acid, viscous paraffin, perfume oil, fatty acid monoglycerides and diglycerides, petroethral fatty acid esters, hydroxymethyl-cellulose, polyvinylpyrrolidone, and the like.

Exemplary excipients for the forms include lactose, starch, a cellulose, milk sugar or high molecular weight polyethylene glycols.

For aqueous suspensions and/or elixirs, the composition of the present invention may be combined with various sweetening or flavouring agents, colouring matter or dyes, with emulsifying and/or suspending agents and with diluents such as water, propylene glycol and glycerin, and combinations thereof.

The forms may also include gelatin capsules; fibre capsules, fibre tablets etc.; or even beverages.

Further examples of forms are in the form of a cream for example. For some aspects the microorganism may be included in pharmaceutical and/or cosmetic creams such as sun creams and/or after-sun creams for example.

In one aspect, the composition according to the present invention may be administered in an aerosol, for example by way of a nasal spray, for instance for administration to the respiratory tract.

According to a specific embodiment, the microbial species/strains as described herein are dispensed from an aerosol dispensing device (or system).

There are devices known to atomize a liquid and deliver the atomized liquid into the surrounding air.

According to a specific embodiment the aerosol dispensing device is automated.

Such an aerosol dispersing device can work on its own as well as in conjunction with an HVAC system.

Reference is now made to FIG. 13 showing a simplified schematic drawing of an example aerosol dispensing device with a replaceable cartridge that is actuated with compressed air in accordance with some example embodiments. An aerosol dispensing device 200 includes a housing 201 that may house an air compressor 104 to actuate atomizing a liquid 159 contained in a cartridge 150. Pressurized air provided by compressor 104 may be delivered through valve 102 and a channel 112, e.g. a tube to a connector 118. Connector 118 may establish a fluid connection between compressor 104, cartridge 150 and an aerosol outlet 129 from which atomized liquid 125 may be expelled. An atomizer 120 may be integrated in connector 118 or in collar 152 of cartridge 150. Optionally, an adaptor 119 provides a sealed connection between cartridge 150 and connector 118. Although connector 118 and adaptor 119 are shown as two separate elements, it is understood that functionality of these two elements may be integrated into a single part.

According to some example embodiments, at least one of a cartridge for an aerosol dispensing device and the aerosol dispensing device includes a mechanism for stirring liquid contents of the cartridge. Optionally, liquid content in the cartridge may be stirred continuously or periodically during use to maintain a substantially constant concentration of active material over a height of the liquid.

In some example embodiments, device 200 is self-powered with a power source 108. Alternatively, device 200 may be powered by an external power source. In some example embodiments, device 200 includes a user interface including for example a display 103 and one or more user actuated buttons or knobs 107.

Device 200 may be positioned in an indoor environment. The indoor environment may be a public space such as a hospital or a shopping center or may be a personal space such as an office, a home or a vehicle. Optionally, device 200 may be configured to direct aerosol 125 expelled from channel 129 into airflow ducts of a heating, ventilation and air conditioning (HVAC) system. Optionally, circuit 105 is in communication or receives input from an HVAC system and is operated in coordination with the HVAC system. Alternatively, device 200 may be operated independently from an HVAC system and the aerosol may also be dispersed directly into the indoor space, e.g. not through the HVAC ducts.

One such configuration is described in U.S. Pat. No. 8,986,610 entitled "Apparatus and method for dispersing liquid in aerosol," the contents of which is incorporated by reference herein, describes a system and method to deliver an atomized solution to the interior volume of a building or room utilizing a Venturi effect for the atomization. It is described that the solution may contain at least one active material including at least one of a medicament, probiotic, nutraceutical, or combinations thereof. The system includes a solution chamber; a Venturi configuration operatively associated with said solution chamber; an air inlet associated with a pressurized air inlet source; an actuator and a sensor. The solution chamber may be in the form of a replaceable cartridge.

In known automated aerosol dispensing devices, the live organism or active material is typically in the form of a water based solution stored in a replaceable cartridge. A device with embodiments having cartridge replacement embodiments is further described hereinbelow.

Reference is now made to FIGS. 14A and 14B showing a simplified schematic drawing of an example aerosol dispensing device and an example replaceable cartridge respectively and to FIG. 15 showing an example replaceable cartridge installed in an example aerosol dispensing device all in accordance with some example embodiments. An aerosol dispensing device 100 includes a housing 101 that may house an actuator 109 configured to actuate atomization of a liquid 159 in a cartridge 150, an outlet channel 129 from which atomized liquid 125 may be expelled and a circuit 105 configured to control operation of actuator 109. An atomizer 120 for creating aerosol 125 based on actuation with actuator 109, may be integrated as part of actuator 109 or may be integrated in cartridge 150. Optionally, actuator 109 is configured to establish fluid connection with cartridge 150. According to some example embodiments, aerosol dispensing device 100 additionally includes a reader 106 configured to read data on a tag 160 included on cartridge 150.

In some example embodiments, device 100 is self-powered with a power source 108. Alternatively, device 100 may be powered by an external power source. In some example embodiments, device 100 includes a user interface including for example a display 103 and one or more user actuated buttons or knobs 107. Optionally, device 100 additionally includes a sensor 117 configured to sense when cartridge 150 is installed in device 100. Sensor 117 may for example be an opto-coupler sensor that detects a break in a line of sight due to insertion of neck 152 into actuator 109. In another example, sensor 117 may be a button switch that is compressed based on insertion of collar 152 into actuator 109.

Device 100 may be positioned in an indoor environment. The indoor environment may be a public space such as a hospital or a shopping center or may be a personal space such as an office, a home or a vehicle. Optionally, device 100 may be configured to direct aerosol 125 expelled from channel 129 into airflow ducts of a heating, ventilation and air conditioning (HVAC) system. Optionally, circuit 105 is in communication or receives input from an HVAC system and is operated in coordination with the HVAC system. Alternatively, device 100 may be operated independently from an HVAC system and the aerosol may also be dispersed directly into the indoor space, e.g. not through the HVAC ducts.

According to some example embodiments, liquid 159 may include sensitive material such as a pro-biotic, medicament, nutraceutical, or combinations thereof that may be prone to contamination. The material when contaminated may pose a health hazard. Furthermore, any malicious tampering with cartridge 150 may also lead to a hazardous situation. For example an offender may maliciously insert a harmful bacteria or an irritant into cartridge 150. Alternately, an offender may attempt to refill cartridge 150 with unknown or unregulated contents that may not be suitable or safe in general or for a particular indoor space. In other examples, a hazardous situation may be created without malicious intent, for example when a solution in the cartridge has passed its expiration date or when a property of the solution has been altered due to prolonged exposure to humidity or air.

According to some example embodiments, circuit 105 includes safety verification functionality to verify compatibility, authenticity and safety of cartridge 150 when it is inserted into housing 101 and optionally to provide ongoing monitoring while cartridge 150 is maintained in device 100. The verification may be based on input received from reader 106. In some example embodiments, circuit 105 receives data from reader 106 and compares the data received to information stored in memory. Optionally, if an identification code read by reader 106 matches an identification code listed in the memory, verification may be established. The memory may be memory included in circuit 105, memory included in a remote server 800 or memory included in a cloud. Optionally, the information needed to verify authentication of cartridges may be uploaded by a remote server 800 and circuit 105 may access the information based on wireless communication. According to some example embodiments, circuit 105 is configured to terminate dispersion or formation of atomized liquid 125 and provide an alert when cartridge 150 cannot be positively verified.

Reader 106 may be configured to scan a code or interrogate a tag 160 positioned on cartridge 150, when cartridge 150 is installed in device 100 and provide the data to circuit 105. In some examples, reader 106 is or includes a camera or a RFID scanner that is configured to detect data stored on cartridge 150. Preferably, reader 106 is an active reader that is controlled and powered with circuit 105. In some example embodiments, controller 105 activates reader 106 at a defined frequency, e.g. every 5-60 minutes to scan or interrogate tag 160. Additionally or alternatively, controller 105 may activate reader at defined events. For example controller 105 may activate reader when power of device 100 is turned on and during installation of cartridge 150 in the device 100. In some example embodiments communication between reader 106 and tag 160 is wireless or contactless. In other example embodiments, communication between reader 106 and tag 160 is based on electrical contact.

Optionally, cartridge 150 configured for use with device 100 includes tag or code 160 with data to verify its compatibility. Tag or code 160 may be a barcode, e.g. a one dimensional or two dimensional barcode, maybe in passive RFID tag and may be an active RFID tag. Tag or code 160 may be positioned in an inner surface of cartridge 150 that is in contact with fluid 159 or may be positioned on an outer surface of cartridge 150. According to some example embodiments, tag or code 160 may be positioned on cartridge 150 so that it aligns with reader 106 while establishing a sealed connection with actuator 109.

In some example embodiments, tag or code 160 includes passive storage. Information tagged or coded on tag or code 160 may include one or more of the following items: state of a seal on the cartridge, identification data, part number of the product, batch number, production date, expiration date, quantity of material in the cartridge, contents of the cartridge and operating instructions.

Optionally, contents 159 of cartridge 150 are sealed with a seal under cap 151 that is configured to be broken in actuator 109 while inserting cartridge 150 into housing 101. Optionally, breaking of the seal alters data stored in tag or code 160 so that the event may be recorded and detected by reader 106. Optionally, this information may be used to prevent operating device 100 with cartridges that have been refilled. Cartridge 150 may be in the form of a bottle or may be any container that can contain fluid 159 to be dispersed as an aerosol. Typically cartridge 150 is configured to be replaced after its contents have been emptied.

In some example embodiments, tag 160 may be an active tag and reader 106 may transmit data to tag 160 that may be stored in tag 160. Active storage may be a microchip with RAM memory in which case a small power source may be included on cartridge 150. Alternatively, active storage may be an active RFID.

FIG. 16 shows a simplified schematic drawing of an example aerosol dispensing device including one or more sensors in accordance with some example embodiments. According to some example embodiments, the aerosol dispensing device 500 includes a regulator configured to regulate activity of device 500 installed with a cartridge 150. Functionality of the regulator may be included in circuit 105. Optionally, device 500 includes reader 106 and circuit 105 may regulate activity of device 500 based on information received from reader 106, e.g. instruction that may be specific to liquid 159 contained in the cartridge. Circuit 105 may additionally or alternatively regulate activity of device 500 based on inputs from one or more sensors in communication with circuit 105. In some example embodiment, device 500 includes sensors 128 configured to detect a parameter related to content 159 in cartridge 150. Optionally, sensor 128 is a level sensor for detecting a level of liquid 159 in cartridge 150. Optionally, one sensor 128 may be positioned to sense liquid at 1-3 cm from a bottom of cartridge 150 to detect when contents of cartridge 150 are nearly emptied. In some example embodiments, when contents of cartridge 150 are nearly emptied, circuit 105 may provide an alert on display 103 and may also communicate this information to a remote server 800 in communication with circuit 105. Remote server 800 may then alert a service provider or deliver a new cartridge to the site including device 500.

Device 500 may additionally include sensors 127 that may detect environmental conditions. Optionally, humidity is detected. In some example embodiments, temperature is detected. At times, an expiration date may be adjusted based on the detected environmental conditions. For example an expiration date may be shortened in environments with higher humidity as compared to environments that are more arid. Optionally, frequency or duration of actuation may be adjusted based on output detected from one or more of sensors 127, sensors 128 and based on data read with reader 106.

In some example embodiments, device 500 may be configured to receive input from a stand-alone sensor 126 that is remote from device 500. Input may be received based on tethered or wireless connection. Stand-alone sensor 126 may be for example an air quality probe similar to E4000 indoor air quality probe offered by NanoSense, France, a thermostat associated with an HVAC, or a humidity sensor. Input from remote sensors 126 may similarly be used to adjust an expiration date or to adjust frequency or duration of actuation based on the detected environmental conditions.

According to some example embodiments, the aerosol dispensing device 500 additionally includes safety verification functionality as described herein above to verify compatibility, authenticity and safety of cartridge 150 when it is inserted into device 500 and optionally to provide ongoing monitoring while cartridge 150 is maintained in device 500. In some example embodiments, the safety verification functionality is based on reader 106 reading data on a tag 160 included on cartridge 150 and circuit 105 processing the data.

According to some embodiments the bacterial species/strains as described herein or compositions comprising same are not to be used in the treatment of agricultural water (irrigation water), agricultural soils and agricultural crops.

According to some embodiments, the bacterial species/strains as described herein or compositions comprising same can be used in the treatment of agricultural water (irrigation water), agricultural soils and agricultural crops. In still other embodiments, the formulations of cultured bacteria can be applied in the treatment at food processing facilities. In the case of food processing facilities, agricultural waters and soils, the formulations of cultured bacteria can be applied prophylactically or as a sanitizing agent following an exposure. The product can be used to treat foods including meat and meat products. The meat product can generally be any whole, cut, ground or processed meat product, including, ground beef ("hamburger"), ground turkey, ground chicken, ground pork, beef sausage, pork sausage, chicken sausage, turkey sausage, hot dogs, bologna, salami, cold cuts, game hens, whole chicken, lamb, ham, pork, cube meat, steaks, roasts, fillets, fish, or liver.

Any type of agricultural produce sold in marketplaces, such as those derived from plant or fungi, can be treated by the methods and compositions disclosed herein. Additional types of produce products that can be treated by the disclosed antimicrobial compositions include but are not limited to those derived from leaves, stems, fruit, flowers, seeds, roots, and like components that form the plant, as well as those derived from fungi, including the cap, stem, mycelium and annulus, and like components that form the fungi.

Any type of surface can be treated with the bacterial strains/species as described herein. Examples of surfaces that may be treated include of animate surfaces such, as those of animals or plants, and inanimate surface, such as food, buildings, furniture, objects and the like. Specific examples of surfaces that the composition could be applied to include, but are not limited to the following: meat, grinders, processors, extruders, cutting surfaces, cutting apparatus, blades, seafood, agricultural produce (fruit, vegetables, etc.), nuts, legumes, sprouts, trees, leaves, seeds, bulbs, flowers, animals (livestock and pets), eggs shells, skin, hair, bone, horn, hooves, wool, leather, lawns, fields, soil, floors, walls, countertops, cabinets, toilets, bathtubs, bathrooms (portable and non-portable), sinks, laundry equipment, kitchen appliances (refrigerators, freezers, dishwashers, etc.), heating and refrigeration coils, fans, ceiling fans, heating systems, air conditioning system, ventilation systems, internal and external ducts for ventilation, heating and air conditioning, tabletops, chairs and sofas, desks, luggage, fabrics, clothing, footwear, sports equipment, audio/visual equipment, computers, clocks, boxes (cardboard, wood, etc.), books, paper surfaces, garbage/trash receptacles, building materials, interior and exterior of transportation equipment (automobiles, airplanes, trains, boats, etc.), interior and exterior of spacecraft and other space facilities, trailers, tires, metal, ceramic, tile, linoleum, carpet, wall paper, painted surfaces, plastic, vinyl, polyvinyl chloride (PVC) and the like, plastic, rubber, glass, hose line, plumbing (inside and outside), other application machinery, lighting, heating and cooling filaments, ovens, storage containers, bottles, cans, reception areas, milking parlors, food processing facilities, and the like.

The article of manufacture may be packaged in a form that is appropriate or convenient for shipment, administration, or storage. For example, the product can be placed into a hermetically sealed pouch of plastic, paper, metalized plastic, or metal (e.g. aluminum), bottle, cartridge capsule, plastic bag, or a box. In the article of manufacture each strain can be packaged in a separate package or some strains can be combined (e.g., *B. subtilis* 3 and *B. subtilis* 281 strains) or all combined together (composition which comprises all the bacteria).

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is understood that any Sequence Identification Number (SEQ ID NO) disclosed in the instant application can refer to either a DNA sequence or a RNA sequence, depending on the context where that SEQ ID NO is mentioned, even if that SEQ ID NO is expressed only in a DNA sequence format or a RNA sequence format.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N. Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Materials and Methods

Strains

Bacillus strain was isolated from home-made Doenjang using Luria Bertani Miller agar (BD, Difco) agar for plating. Representative colonies were picked from plates with the highest dilution still showing colonies. After purification, the strain was stored at −80° C. The stock culture was propagated first in 10 ml LB Miller broth (in 50 ml Falcon sterile tube) for 18 hours (rotary shaker, 120 RPM), and then the culture was 1% diluted into a fresh media and was propagated in the same conditions as described previously, before each experiment.

Reference strains were obtained from ATCC (American Type Culture Collection) and KACC (Korean Agricultural Culture Collection) and KCTC (Korea, Collection for Type Cultures).

16S rDNA Sequencing

Pure cultures of *Bacillus amyloliquefaciens* 298 was grown on LB Miller agar (BD Difco) at 37° C. for 24 hours. The plate was sent to Solgent Inc. (Deajun, South Korea) for bi-directional 16S rDNA sequencing using (5'-AGA GTT TGATCMTGG CTC AG-3', SEQ ID NO: 1) and 1492R (5'-TAC GGY TAC CTT GTT ACG ACTT-3' SEQ ID NO: 2) primers by (Reysenbach, Giver et al. 1992). Bi-directional sequencing results were assembled using Codon Code Aligner (Codon Code Corporation, USA) and compared with reference sequences of *Bacillus* species on the GenBank database (www(dot)ncbidotnlm(dot)nih(dot)gov/Blastn/).

API Test

Specific sugar fermentation pattern was monitored using API 50CHB strips (Biomerieux). The *Bacillus* strain pellet was prepared using LB Miller agar (BD Difco) at 37° C. for 24 hours and centrifuged 14,000 rpm for 5 min. The pellet was suspended using the preparation media in the kit and applied on different sugars according to the instruction manual.

Hemolysis Test

*B. amyloliquefaciens* 298 was grown at 37° C. for 18 hours in LB broth and then streaked onto 5% sheep blood agar (Hanil Komed) and incubated for 24 h at 37° C. Alpha (α) hemolysis was considered as the partial decomposition of the hemoglobin of the red blood cells, beta (β) hemolysis as the complete breakdown of the hemoglobin of the red blood cells observed as a clear zone in the agar plate and gamma (γ) hemolysis as the lack of hemolysis. *B. cereus* ATCC 27348 was used as a positive control.

Lecithinase Test

*B. amyloliquefaciens* 298 and *B. cereus* ATCC 27348 (positive control) were grown at 37° C. for 18 hours in LB Miller broth and streaked out onto egg yolk agar. The plates were incubated for 24 h at 37° C. and the formation of a white precipitate around the colonies was considered as positive for lecithinase activity (Hong, Huang et al. 2008, Sorokulova, Pinchuk et al. 2008).

Antibiotic Resistance Test

The basic protocol was followed by CLSI recommendation (Jorgensen and Turnidge 2015). Pure cultures of *B.*

*amyloliquefaciens* 298 were cultivated at 37° C. for 18 hours in LB Miller agar. The agar dilution method was used to assess the minimal inhibitory concentration (MIC) of the antibiotics against the strain. A single colony was resuspended in phosphate buffer saline (PBS) 1× and adjusted 0.01 optical density (OD). Ten microliters (1×10$^5$ CFU/mL) of strain were inoculated on the plates using multipin-inoculator and incubated at 37 C for 24 hours. The strain was considered susceptible when they were inhibited at a concentration for a specific antimicrobial equal or lower than the established cut-off value and resistant bacterial strain when it was not inhibited at a concentration of a specific antimicrobial higher than the established cut-off value according to the parameters established by the European Food Safety Authority (EFSA).

Inhalation Infection Test

The animal study was approved by Handong Global University Ethical committee. For the experiment, 40 mice were divided into four groups comprising negative control, two positive controls. infected with pathogenic microorganisms of *Streptococcus pneumoniae* ATCC49619 and *Bacillus cereus* ATCC27348 and one group infected with the tested microorganism. Potential probiotic *B. amyloliquefaciens* 298 was infected at a dose of 1×10$^7$ CFU/mouse with pre-treatment of cyclophosphamide to induce immunocompromised status. The cyclophosphamide was used to derive immunocompromised animal model to monitor more emphasized influence of infected microorganism so called worst case scenario (Kong, Hellermann et al. 2005).

The *B. amyloliquefaciens* 298 was grown for 18 hours in LB Miller broth (BD Difco) at 37° C. while *S. pneumoniae* ATCC49619 was cultured on 5% Sheep blood agar and sub-cultured to Brain Heart Infusion broth (BD Difco) and incubated at 37° C. The bacterial solution was diluted using 1×PBS to 1×10$^7$ CFU/mouse. The inoculum concentration was determined by enumeration of cultured bacteria on agar plates.

The animal lung infection model was carried out in 4-week-old female ICR mice (Hyo-chang science). The mice were anesthetized during respiratory infection (*Streptococcus pneumoniae* ATCC49619 and *Bacillus cereus* ATCC27348) using 50 μL of bacterial suspension through intranasal route. After 24 h post infection, 2 mice of each group were selected randomly and sacrificed with diethyl ether for enumeration of viable colonies in lungs. Lungs were extracted and homogenized with Phosphate-buffered saline (PBS). Before homogenization, lungs were monitored visually. The homogenized lung samples were diluted and spread on 5% Sheep blood agar to enumerate number of pathogens in the lungs. The plates were incubated for 18 hours. The rest of the mice were monitored during 1 week to measure their survival rates (Ginsberg, Moldawer et al. 1991).

Efficacy Tests

The agar well diffusion assay was performed to evaluate the antagonistic activity of *B. amyloliquefaciens* 298 against the growth of pathogenic bacteria including *Escherichia coli* ATCC 22922, *Pseudomonas aeruginosa*, *B. cereus* ATCC 27348, *Staphylococcus aureus* ATCC 11335, *Salmonella Typhimurium* ATCC 14028 and *Listeria innocua* ATCC 3586. The antagonistic activity of *B. amyloliquefaciens* 298 was also verified against molds such as *Alternaria alternata* (Fries) Keissler (ATCC® MYA-4642™), *Cladosporium sphaerospermum* Penzig (ATCC® MYA-4645™) and *Penicillium chrysogenum* Thom (ATCC® MYA-4644™). Brain Heart Infusion (BHI) Agar was used for the antagonism against pathogenic microorganisms while the Potato Dextrose Agar (PDA) was used for evaluation against molds. Reference pathogens were prepared using BHI broth at 37° C. for 18 hours while *B. amyloliquefaciens* 298 was grown using LB broth at 37° C. for 18 hours. Molds were prepared using PDA at 25° C. with 85% HR for 7 days. Mold spores, pathogens and *B. amyloliquefaciens* 298 were harvested and resuspended in PBS. Pathogens and *B. amyloliquefaciens* 298 were adjusted to an optical density of 0.2 and 100 uL of pathogen suspended in PBS was spread on BHI agar plates. The same amount of mold spore suspension was inoculated on PDA. Wells were made in all the plates and 20 μL of *B. amyloliquefaciens* 298 suspensions were inoculated in the wells while the BHI plates were incubated at 37° C. for 24 hours and PDA plates at 25° C. for 72 hours. The inhibition of pathogens and molds was observed as a clear zone around the *bacillus* strain inoculated wells and 10% hydrogen peroxide served as a positive control.

16S rDNA Sequence

The identity of the strain was confirmed as *B. subtilis* according to the National Center for Biotechnology Information (NCBI) database according to the 16S-rRNA (SEQ ID NO: 3) sequencing result.

Complete Genome Sequence

The complete genome sequence of *B. amyloliquefaciens* 298 was generated using the PacBio RS platform with single-molecule real-time (SMRT) sequencing at Theragenetex (Seoul, South Korea). Annotations were performed by merging the results obtained from the Rapid Annotations using Subsystems Technology (RAST) server, Glimmer 3.02 modeling software, tRNAscan-SE 2.0, and RNAmmer 1.2. In addition, the contigs were searched against the KEGG, UniProt, and Clusters of Orthologous Groups (COG) databases to annotate the gene description. The results are shown in SEQ ID NO: 4.

Metabolite Analysis

Total protein was extracted from growth media of *B. amyloliquefaciens* 298 after 18 hours at 37° C. incubation to evaluate the secreted metabolites of *B. amyloliquefaciens* 298. A stock solution was prepared dissolving 500 g of Trichloroacetic acid (TCA) into 350 ml of distilled water. 1 volume of TCA stock solution was added to 4 volumes of *B. amyloliquefaciens* 298 growth media and incubated at 4° C. for 10 min. The tube was centrifuged at 14,000 rpm for 5 min and supernatant was removed to concentrate the protein pellet. The pellet was washed with 200 μl cold acetone and again concentrated by 14,000 rpm centrifugation for 5 min. This step was repeated for three times and the pellet was sent to be analyzed using LC-LTQ-Orbitrap at Technopark Biocenter (Pohang, South Korea). The raw data was analyzed using UniProt database to match predicted proteins from the growth media of *B. amyloliquefaciens* 298.

Example 1A

In-Vitro Safety Evaluation of Lecithinase and Hemolysis Activity

*B. amyloliquefaciens* 298 did not show lecithinase activity observed as the absence of a white precipitate around the *Bacillus* colonies and all *B. amyloliquefaciens* 298 showed negative reaction for hemolysis as well.

TABLE 1

Lecithinase and hemolysis activity of *B. amyloliquefaciens* 298 and *B. cereus* ATCC 27348.

| Strain | Lecithinase activity | Hemolysis activity |
|---|---|---|
| *Bacillus amyloliquefaciens* 298 | Negative | Gamma |
| *Bacillus cereus* ATCC 27348 (positive control) | Positive | Beta |

Example 1B

In-Vitro Evaluation of Antibiotic Resistance

The agar dilution was used to evaluate the minimal inhibitory concentration (MIC) of antibiotics. *B. amyloliquefaciens* 298 was found to be sensitive to erythromycin, gentamicin, tetracycline, streptomycin, vancomycin, chloramphenicol, kanamycin and clindamycin according to the European Food Safety Authority MIC breakpoints for *Bacillus* species. The determined MIC values are clearly below or equal to the EFSA breakpoint values (Table 2).

TABLE 2

Minimum inhibitory concentrations (MIC) of *B. amyloliquefaciens* 298. Antibiotic resistance test

| Strain | Minimum inhibitory concentration (mg/L) of antibiotics | | | | | | | |
|---|---|---|---|---|---|---|---|---|
| | Ery | Gen | Tet | Str | Van | Chl | Kan | Cli |
| *B. amyloliquefaciens* 298 | ≤0.125 | ≤2 | ≤0.125 | 8 | 0.25 | ≤4 | ≤4 | 0.5 |
| EFSA breakpoint | 4 | 4 | 8 | 8 | 4 | 8 | 8 | 4 |

Ery: Erythromycin;
Gen: Gentamicin;
Tet: Tetracycline;
Str: Streptomycin;
Vm: Vancomycin;
Chl: Chloramphenicol;
Kan: Kanamycin;
Cli: Clindamycin.

Example 1C

Respiratory Tract Infection Test

Figure 2:
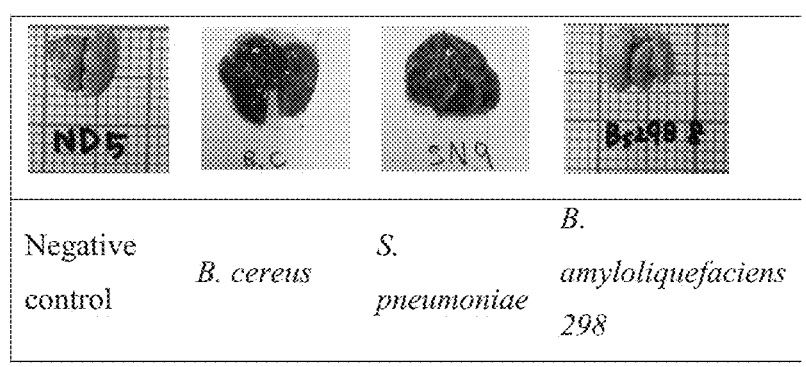
FIG. 2 is a photograph showing the appearance of lungs in each group described in FIG. 1.

The survival rate after respiratory tract infection of *B. amyloliquefaciens* 298 was 100% while the positive control of pathogenic bacteria infected groups including *S. pneumoniae* and *B. cereus* showed 100% mortality after 24 hours (FIG. 1). Lung pictures were taken and showed strong damage in pathogen infected positive groups while lung of *B. amyloliquefaciens* 298 infected groups showed similar lung status as negative control group (FIG. 2) and any colony of *Bacillus* was found from the homogenized lung of *B. amyloliquefaciens* 298 infected group (data not shown). These data demonstrate that *B. amyloliquefaciens* 298 does not infect lung probably due to lack of colonization in the lung.

Example 1D

Efficacy Tests

Figure 3:
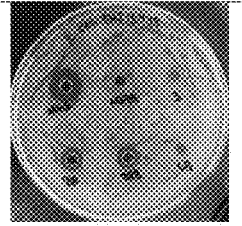
FIG. 3 is a photograph showing antagonism of pathogenic bacteria by *B. amyloliquefaciens* 298.
Figure 3:
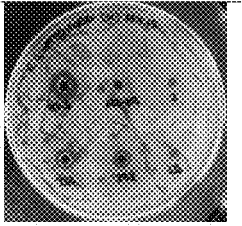
Figure 3:
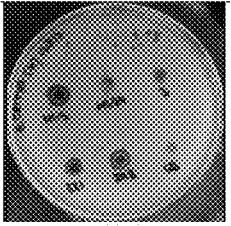
Figure 3:
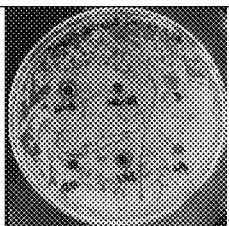
Figure 3:
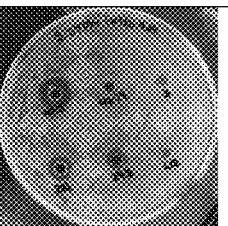
Figure 3:
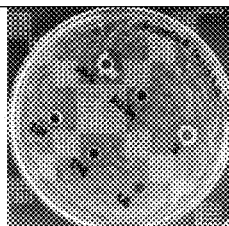

The antagonism test results of *B. amyloliquefaciens* 298 showed inhibited growth of *E. coli* ATCC 22922, *P. aeruginosa*, *B. cereus* ATCC 27348 and *S. Typhimurium* ATCC 14028 at different degrees (FIG. 3 and Table 3).

TABLE 3

Antagonistic activity of *Bacillus amyloliquefaciens* 298 against pathogens.

| Pathogens | *B. amyloliquefaciens* 298 |
|---|---|
| *Escherichia coli* ATCC 22922 | 2 |
| *Pseudomonas aeruginosa* | 1 |
| *Bacillus cereus* ATCC 27348 | 2 |
| *Staphylococcus aureus* ATCC 11335 | 1 |
| *Salmonella Typhimurium* ATCC 14028 | 2 |
| *Listeria innocua* ATCC 3586 | NA |

NA: No antagonism was observed

Figure 4:
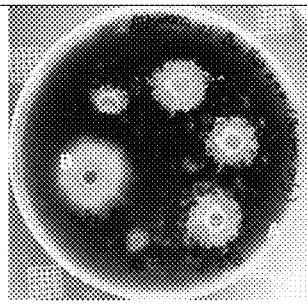
FIG. 4 is a photographic representation of results for the antagonism of test molds using *B. amyloliquefaciens* 298 (A) and 10% hydrogen peroxide (B) as a positive control.
Figure 4:
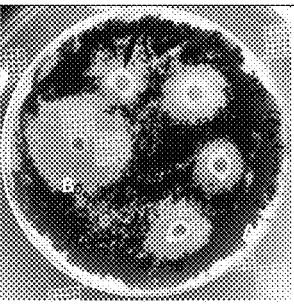
Figure 4:
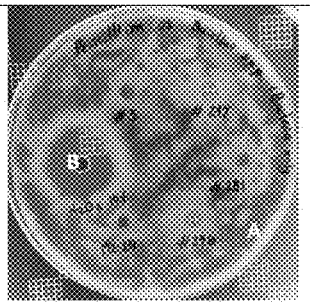

*B. amyloliquefaciens* 298 antagonism against mold indicates positive antagonism against *Alternaria alternata* (Fries) Keissler (ATCC® MYA-4642™) and *Cladosporium sphaerospermum* Penzig (ATCC® MYA-4645™) at variable level (Table 4). The inhibition of the mold growth is evidently expressed as a clear zone around the wells inoculated with the *B. amyloliquefaciens* 298 (FIG. 4). *Penicillium chrysogenum* Thom (ATCC® MYA-4644™) was not inhibited at all for any of the strains used on this experiment, however the mycelium color around the well inoculated with *B. amyloliquefaciens* 298 show and slightly decrease in the intensity (data not shown) from green to white.

TABLE 4

Antifungal activity of *Bacillus amyloliquefaciens* 298 against molds.

| | Inhibition zone (mm) | | |
|---|---|---|---|
| Strain | *Alternaria alternata* (Fries) Keissler (ATCC MYA-4642) | *Cladosporium sphaerospermum* Penzig (ATCC MYA-4645) | *Penicillium chrysogenum* Thom (ATCC MYA-4644) |
| *Bacillus amyloliquefaciens* 298 | 6 | 6 | NA |
| Hydrogen peroxide 10% | 8 | 12 | 10 |

NA: No antagonism was observed

Example 1E

Taxonomic Identification

The identity of the strain was confirmed as *B. subtilis* according to the National Center for Biotechnology Information (NCBI) database. API results were monitored for further identification of physiological characteristics.

Example 1F

Complete Genome Sequence

A Single run of PacBio provided total number of 151,771 reads which comprises in total of 1,368,609,189 bases. Raw data was assembled using Canu v1.6 and single contig was produced in size of 3,928,316 base pairs (Separate attached text file of "*Bacillus amyloliquefaciens* 298.fasta"). Total number of genes were 3,854 (3,740 coding sequences) and 3,044 annotated genes were found which calculated as 81.39% of total genes (gene annotations are listed in Table 5 below).

Lengthy table referenced here

US11602550-20230314-T00001

Please refer to the end of the specification for access instructions.

Example 2

Materials and Methods

Strains

*Bacillus* strains were isolated from home-made Doenjang using Luria Bertani Miller agar (BD, Difco) agar for plating. Representative colonies were picked from plates with the highest dilution still showing colonies. After purification, the strains were stored at −80° C. Before each experiment, the stock culture was cultured in 10 ml LB Miller broth (BD, Difco) in 50 ml falcon sterile tubes for 18 hours at 37° C. in a shaking incubator (rotatory, 120 RPM), the tubes were located in a slope position at an angle of ca80° relative to the vertical line. Then 1% diluted to fresh media (and grown in the same conditions). The culture was then streaked on LB Miller agar (BD, Difco) and incubated for 18 hours. Representative colony was picked and cultured on LB Miller broth (BD, Difco) at 37° C. in a shaking incubator (rotatory, 120 RPM according to the time indicated at each test. Reference strains were obtained from ATCC (American Type Culture Collection) and KACC (Korean Agricultural Culture Collection) and KCTC (Korea, Collection for Type Cultures).

16S rDNA Sequencing

Pure cultures of *Bacillus subtilis* 3 were grown on LB Miller agar (BD Difco) at 37° C. for 24 hours. The plate was sent to Solgent Inc. (Deajun, South Korea) for bi-directional 16S rDNA sequencing using (5'-AGA GTT TGATCMTGG CTC AG-3', SEQ ID NO: 1) and 1492R (5'-TAC GGY TAC CTT GTT ACG ACTT-3', SEQ ID NO: 2) primers by (Reysenbach, Giver et al. 1992). Bi-directional sequencing results were assembled using Codon Code Aligner (Codon Code Corporation, USA) and compared with reference sequences of *Bacillus* species on the GenBank database (www(dot)ncbi(dot)nlm(dot)nih(dot)gov/Blastn/).

API Test

Specific sugar fermentation pattern was monitored using API 50CHB strips (Biomerieux). The *Bacillus* strain pellet was prepared using LB Miller agar (BD Difco) at 37° C. for 24 hours and centrifuged 14,000 rpm for 5 min. The pellet was suspended using the preparation media in the kit and applied on different sugars according to the instruction manual.

Hemolysis Test

*B. subtilis* 3 was grown at 37° C. for 18 hours in LB broth and then streaked onto 5% sheep blood agar (Hanil Komed) and incubated for 24 h at 37° C. Alpha (α) hemolysis was considered as the partial decomposition of the hemoglobin of the red blood cells, beta (β) hemolysis as the complete breakdown of the hemoglobin of the red blood cells observed as a clear zone in the agar plate and gamma (γ) hemolysis as the lack of hemolysis. *B. cereus* ATCC 27348 was used as a positive control.

Lecithinase Test

*B. subtilis* 3 and *B. cereus* ATCC 27348 (positive control) were grown at 37° C. for 18 hours in LB Miller broth and streaked out onto egg yolk agar. The plates were incubated for 24 h at 37° C. and the formation of a white precipitate around the colonies was considered as positive for lecithinase activity (Hong, Huang et al. 2008, Sorokulova, Pinchuk et al. 2008).

Antibiotic Resistance Test

The basic protocol was followed by CLSI recommendation (Jorgensen and Turnidge 2015). Pure cultures of *B. subtilis* 3 were cultivated at 37° C. for 18 hours in LB Miller agar. The agar dilution method was used to assess the minimal inhibitory concentration (MIC) of the strain against antibiotics. A single colony was resuspended in phosphate buffer saline (PBS) 1× and adjusted 0.01 optical density (OD). Ten microliters ($1 \times 10^5$ CFU/mL) of strain were inoculated on the plates using multipin-inoculator and incubated at 37° C. for 24 hours. The strain was considered susceptible when they were inhibited at a concentration for a specific antimicrobial equal or lower than the established cut-off value and resistant bacterial strain when it was not inhibited at a concentration of a specific antimicrobial higher than the established cut-off value according to the parameters established by the European Food Safety Authority (EFSA).

Inhalation Infection Test

The animal study was approved by Handong Global University Ethical committee. For the experiment, 40 mice were divided into four groups comprising negative control, two positive controls infected with pathogenic microorganisms of *Streptococcus pneumoniae* ATCC49619 and *Bacillus cereus* ATCC27348. Potential probiotic *B. subtilis* 3 was infected in dose of $1 \times 10^7$ CFU/mouse with pre-treatment of cyclophosphamide to induce immunocompromised status. The cyclophosphamide was used to derive immunocompromised animal model to monitor more emphasized influence of infected microorganims so called worst case scenario (Kong, Hellermann et al. 2005). The *Bacillus* strain was grown for 18 hours in LB Miller broth (BD Difco) at 37° C. while *S. pneumoniae* ATCC49619 was cultured on 5% Sheep blood agar and subcultured to Brain Heart Infusion broth (BD Difco) and incubated at 37° C. The bacterial solution was diluted using 1×PBS to $1 \times 10^7$ CFU/mouse. The inoculum concentration was determined by enumeration of cultured bacteria on agar plates.

The animal lung infection model was carried out in 4-week-old female ICR mice (Hyo-chang science). The mice were anesthetized during respiratory infection using 50 µL of bacterial suspension through intranasal route. After 24 h post infection, 2 mice of each group were selected randomly and sacrificed with diethyl ether for enumeration of viable colonies in lungs. Lungs were extracted and homogenized with Phophate-buffered saline (PBS). Before homogenization, lungs were monitored visually. The homogenized lung samples were diluted and spread on 5% Sheep blood agar to enumerate number of pathogens in the lungs. The plates were incubated for 18 hours. The rest of the mice were monitored during 1 week to measure their survival rates (Ginsberg, Moldawer et al. 1991).

Efficacy Tests

The agar well diffusion assay was performed to evaluate the antagonistic activity of B. subtilis 3 against the growth of pathogenic bacteria including Escherichia coli ATCC 25922, Pseudomonas aeruginosa ATCC 27853, B. cereus ATCC 27348, Staphylococcus aureus ATCC 6538, Salmonella Typhymurium ATCC 14028 and Listeria inocua ATCC 33090. The antagonistic activity of B. subtilis 3 was also verified against molds such as Alternaria alternata (Fries) Keissler (ATCC® MYA-4642™), Cladosporium sphaerospermum Penzig (ATCC® MYA-4645™) and Penicillium chrysogenum Thom (ATCC® MYA-4644™). Brain Heart Infusion (BHI) Agar was used for the antagonism against pathogenic microorganisms while the Potato Dextrose Agar (PDA) was used for evaluation against molds. Reference pathogens were prepared using BHI broth 37° C. for 18 hours, while B. subtilis 3 was grown using LB broth at 37° C. for 18 hours. Molds were prepared using PDA at 25° C. with 85% HR for 7 days. Mold spores, pathogens and B. subtilis 3 were harvested and resuspended in PBS. Pathogens and B. subtilis 3 was adjusted at optical density of 0.2 and 100 μL of pathogen suspended in PBS was spreaded on BHI agar plates. The same amount of mold spore suspension was inoculated on PDA. Wells were made in all the plates and 20 μL of B. subtilis 3 suspensions were inoculated in the holes while the BHI plates were incubated at 37° C. for 24 hours and PDA plates at 25° C. for 72 hours. The inhibition of pathogens and molds were observed as a clear zone around the bacillus strain inncoulated wells and 10% hydrogen peroxide was served as a positive control.

Complete Genome Sequence

The complete genome sequence of B. subtilis 3 was generated using the PacBio RS platform with single-molecule real-time (SMRT) sequencing at Theragenetex (Seoul, South Korea). Annotations were performed by merging the results obtained from the Rapid Annotations were performed by merging the results obtained from the Papid Annotaions using Subsystems Technology (RAST) server, Glimmer 3.02 modeling software, tRNAscan-SE 2.0, and RNAmmer 1.2. In addition, the contigs were searched against the KEGG, UniProt, and Clusters of Orthologous Groups (COG) databses to annotate the gene description.

Metabolite Analysis

Total protein was extracted from growth media of B. subtilis 3 after 18 hours at 37° C. incubation to evaluate metabolite of B. subtilis 3. Stock solution was prepared dissolving 500 g of Trichloroacetic acid (TCA) into 350 ml of distilled water. 1 volume of TCA stock solution was added to 4 volumes of B. subtilis 3 growth media and incubated at 4° C. for 10 min. Tube was centrifuged at 14,000 rpm for 5 min and supernatant was removed to concentrate protein pellet. The pellet was washed with 200 μL of cold acetone and again concentrated by 14,000 rpm centrifugation for 5 min. This step was repeated three times and the pellet was sent to be analyzed using LC-LTQ-Orbitrap at Technopark Biocenter (Pohang, South Korea). The raw data was analyzed using UniProt database to match predicted proteins from the growth media of B. subtilis 3.

Example 2A

In-Vitro Safety Evaluation of Lecithinase and Hemolysis Activity

B. subtilis 3 did not show lecithinase activity observed as the absence of a white precipitate around the Bacillus colonies and B. subtilis 3 showed negative reaction for hemolysis as well.

TABLE 6

Lecithinase and hemolysis activity of B. subtilis 3 and B. cereus ATCC 27348.

| Strain | Lecithinase activity | Hemolysis activity |
| --- | --- | --- |
| Bacillus subtilis 3 | Negative | Gamma |
| Bacillus cereus ATCC 27348 (positive control) | Positive | Beta |

Example 2B

In-Vitro Evaluation of Antibiotic Resistance

The agar dilution was used to evaluate the minimal inhibitory concentration (MIC) of antibiotics. B. subtilis 3 was found to be sensitive to erythromycin, gentamicin, tetracycline, streptomycin, vancomycin, chloramphenicol, kanamycin and clindamycin according to the European Food Safety Authority MIC breakpoints for Bacillus species. The determined MIC values are clearly below or equal to the EFSA breakpoint values (Table 2).

TABLE 7

Minimum inhibitory concentrations (MIC) of B. subtilis 3. Antibiotic resistance test

| Strain | Minimum inhibitory concentration (mg/L) of antibiotics | | | | | | | |
| --- | --- | --- | --- | --- | --- | --- | --- | --- |
| | Ery | Gen | Tet | Str | Van | Chl | Kan | Cli |
| B. subtilis 3 | ≤2 | ≤2 | ≤4 | 8 | ≤2 | ≤4 | ≤4 | 4 |
| EFSA breakpoint | 4 | 4 | 8 | 8 | 4 | 8 | 8 | 4 |

Ery: Erythromycin;
Gen: Gentamicin;
Tet: Tetracycline;
Str: Streptomycin;
Vm: Vancomycin;
Chl: Chloramphenicol;
Kan: Kanamycin;
Cli: Clindamycin.

Example 2C

Respiratory Tract Infection Test

Figure 5:
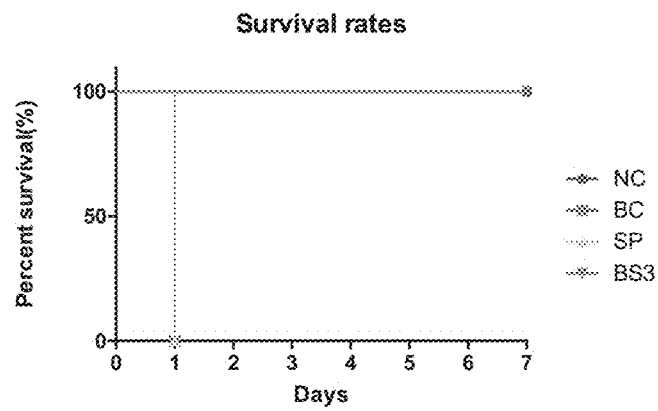
FIG. 5 is a graph showing Survival rates of mice after respiratory tract infection (NC: negative control, BC: *B. cereus*, SP: *S. pneumoniae*, BS3: *B. subtilis* 3).
Figure 6:
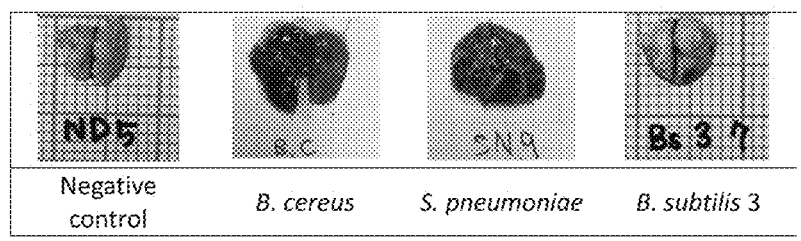
FIG. 6 is a photograph showing the appearance of lungs in each group described in FIG. 5.

The survival rate after respiratory tract infection of three candidates of B. subtilis 3 was 100% while the positive control of pathogenic bacteria infected groups including S. pneumoniae and B. cereus showed 100% mortality after 24 hours (FIG. 5). All lung pictures were taken and showed strong damage in pathogen infected positive groups, while lung of B. subtilis 3 infected groups showed similar lung status as negative control group (FIG. 6) and no colony of *Bacillus* was found from the homogenized lung of *B. subtilis* 3 infected group (data not shown).

Example 2D

Efficacy Tests

Figure 7:
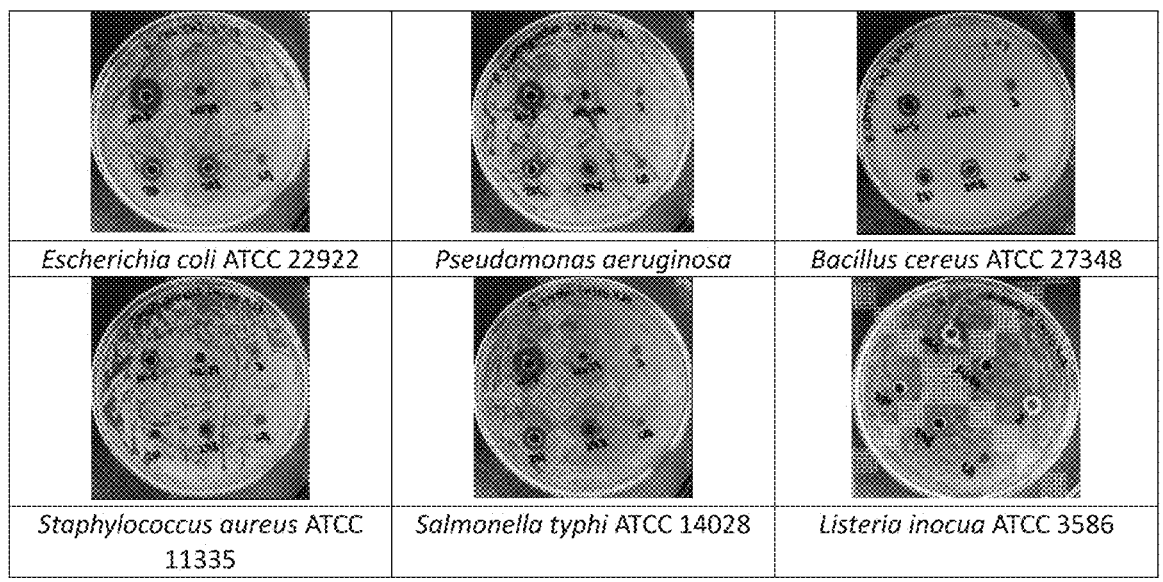
FIG. 7 is a photograph showing antagonism of pathogenic bacteria by *B. subtilis* 3.

The antagonism test results of *B. subtilis* 3 against pathogenic bacteria indicate that *B. subtilis* 3 reduce the growth of *E. coli* ATCC 22922, *S. aureus* ATCC 11335 and *L. inocua* ATCC 3586 at various levels (FIG. 7).

TABLE 8

| Antagonistic activity of *Bacillus subtilis* 3 against pathogens. | |
|---|---|
| Pathogens | *B. subtilis* 3 |
| *Escherichia coli* ATCC 25922 | 1 |
| *Pseudomonas aeruginosa* ATCC 27853 | NA |
| *Bacillus cereus* ATCC 27348 | NA |
| *Staphylococcus aureus* ATCC 6538 | 1 |
| *Salmonella Typhmurium* ATCC 14028 | NA |
| *Listeria inocua* ATCC 33090 | 2 |

NA: No antagonism was observed

Figure 8:
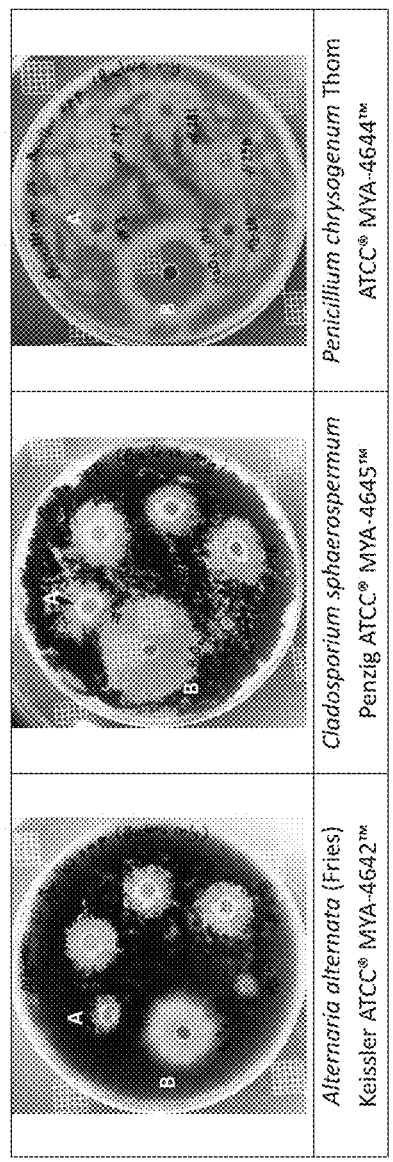
FIG. 8 is a photograph showing antagonism of molds using *B. subtilis* 3 (A) and 10% hydrogen peroxide (B) as a positive control.

*B. subtilis* 3 antagonism against mold indicate positive antagonism against *Alternaria alternata* (Fries) Keissler (ATCC® MYA-4642™) and *Cladosporium sphaerospermum* Penzig (ATCC® MYA-4645™) at variable level (Table 4). The inhibition of the mold growth is evidently expressed as a clear zone around the wells inoculated with the *B. subtilis* 3 (FIG. 8). *Penicillium chrysogenum* Thom (ATCC® MYA4644™) was not inhibited at all for any of the strains used on this experiment.

TABLE 9

| Antifungal activity of *Bacillus subtilis* 3 against molds. | | | |
|---|---|---|---|
| | Inhibition zone (mm) | | |
| Strain | *Alternaria alternata* (Fries) Keissler (ATCC MYA-4642) | *Cladosporium sphaerospermum* Penzig (ATCC MYA-4645) | *Penicillium chrysogenum* Thom (ATCC MYA-4644) |
| *Bacillus subtilis* 3 | 2 | 4 | NA |
| Hydrogen peroxide 10% | 8 | 12 | 10 |

NA: No antagonism was observed

Example 2E

Taxonomic Identification

The identity of the strain was confirmed as *B. subtilis* according to the National Center for Biotechnology Information (NCBI) database. API results were monitored for further identification of physiological characteristics.

Example 2F

16S rRNA

The identity of the strain having the 16S rRNA sequence as set forth in SEQ ID NO: 5 was confirmed as *B. subtilis*, according to the National Center for Biotechnology Information (NCBI) database.

Example 2G

Complete Genome Sequence

Single run of PacBio provided total number of 187,256 reads which comprises in total of 1,717,197,946 bases. Raw data was assembled using Canu v1.6 and single contig was produced in size of 4,096,210 base pairs (Separate attached text file of "*Bacillus subtilis* 3.fasta"). Total number of genes were 4,338 (4,220 coding sequences) and 3,387 annotated genes were found which calculated as 80.26% of total genes.

Lengthy table referenced here

US11602550-20230314-T00002

Please refer to the end of the specification for access instructions.

Example 3

Materials and Methods

Strains

*Bacillus* strains were isolated from home-made Doenjang using Luria Bertani Miller agar (BD, Difco) agar for plating. Representative colonies were picked from plates with the highest dilution still showing colonies. After purification, the strains were stored at −80° C. Before each experiment, the stock culture was cultured in 10 ml LB Miller broth (BD, Difco) in 50 ml falcon sterile tubes for 18 hours at 37° C. in a shaking incubator (rotatory, 120 RPM), the tubes were located in a slope position at an angle of ca80° relative to the vertical line. Then 1% diluted to fresh media (and grown in the same conditions). The culture was then streaked on LB Miller agar (BD, Difco) and incubated for 18 hours. Representative colony was picked and cultured on LB Miller broth (BD, Difco) at 37° C. in a shaking incubator (rotatory, 120 RPM according to the time indicated at each test). Reference strains were obtained from ATCC (American Type Culture Collection) and KACC (Korean Agricultural Culture Collection) and KCTC (Korea, Collection for Type Cultures).

16S rDNA Sequencing

Pure cultures of *Bacillus subtilis* 281 were grown on LB Miller agar (BD Difco) at 37° C. for 24 hours. The plate was sent to Solgent Inc. (Deajun, South Korea) for bi-directional 16S rDNA sequencing using (5'-AGA GTT TGATCMTGG CTC AG-3', SEQ ID NO: 1) and 1492R (5'-TAC GGY TAC CTT GTT ACG ACTT-3' SEQ ID NO: 2) primers by (Reysenbach, Giver et al. 1992). Bi-directional sequencing results were assembled using Codon Code Aligner (Codon Code Corporation, USA) and compared with reference sequences of *Bacillus* species on the GenBank database (www(dot)ncbi(dot)nlm(dot)nihdotgov/Blastn/).

API Test

Specific sugar fermentation pattern was monitored using API 50CHB strips (Biomerieux). The Bacillus strain pellet was prepared using LB Miller agar (BD Difco) at 37° C. for 24 hours and centrifuged 14,000 rpm for 5 min. The pellet was suspended using the preparation media in the kit and applied on different sugars according to the instruction manual.

Hemolysis Test

Bacillus subtilis 281 was grown at 37° C. for 18 hours in LB broth and then streaked onto 5% sheep blood agar (Hanil Komed) and incubated for 24 h at 37° C. Alpha (α) hemolysis was considered as the partial decomposition of the hemoglobin of the red blood cells, beta (β) hemolysis as the complete breakdown of the hemoglobin of the red blood cells observed as a clear zone in the agar plate and gamma (γ) hemolysis as the lack of hemolysis. B. cereus ATCC 27348 was used as a positive control.

Lecithinase Test

Bacillus subtilis 2818 and B. cereus ATCC 27348 (positive control) were grown at 37° C. for 18 hours in LB Miller broth and streaked out onto egg yolk agar. The plates were incubated for 24 h at 37° C. and the formation of a white precipitate around the colonies was considered as positive for lecithinase activity (Hong, Huang et al. 2008, Sorokulova, Pinchuk et al. 2008).

Antibiotic Resistance Test

The basic protocol was followed by CLSI recommendation (Jorgensen and Turnidge 2015). Pure cultures of Bacillus subtilis 281 were cultivated at 37° C. for 18 hours in LB Miller agar. The agar dilution method was used to assess the minimal inhibitory concentration (MIC) of the antibiotics against the strain. A single colony was resuspended in phosphate buffer saline (PBS) 1× and adjusted to 0.01 optical density (OD). Ten microliters ($1 \times 10^5$ CFU/mL) of strain were inoculated on the plates using multipin-inoculator and incubated at 37 C for 24 hours. The strain was considered susceptible when they were inhibited at a concentration for a specific antimicrobial equal or lower than the established cut-off value and resistant bacterial strain when it was not inhibited at a concentration of a specific antimicrobial higher than the established cut-off value according to the parameters established by the European Food Safety Authority (EFSA).

Inhalation Infection Test

The animal study was approved by Handong Global University Ethical committee. For the experiment, 40 mice were divided into four groups comprising negative control, two positive controls infected with pathogenic microorganisms of Streptococcus pneumoniae ATCC49619 and Bacillus cereus ATCC27348 and one group infected with the tested microorganism. Potential probiotic Bacillus subtilis 281 was infected at a dose of $1 \times 10^7$ CFU/mouse with pre-treatment of cyclophosphamide to induce immunocompromised status. The cyclophosphamide was used to derive an immunocompromised animal model in order to monitor more pronounced influence of the infected microorganism as a so called worst case scenario (Kong, Hellermann et al. 2005).

The Bacillus subtilis 281 was grown for 18 hours in LB Miller broth (BD Difco) at 37° C. while S. pneumoniae ATCC49619 was cultured on 5% Sheep blood agar and sub-cultured in Brain Heart Infusion broth (BD Difco) and incubated at 37° C. The bacterial solution was diluted using 1×PBS to $1 \times 10^7$ CFU/mouse. The inoculum concentration was determined by enumeration of cultured bacteria on agar plates.

The animal lung infection model was carried out in 4-week-old female ICR mice (Hyo-chang science). The mice were anesthetized during respiratory infection using 50 μL of bacterial suspension through the intranasal route. After 24 h post infection, 2 mice of each group were selected randomly and sacrificed with diethyl ether for enumeration of viable colonies in lungs. Lungs were extracted and homogenized with phosphate-buffered saline (PBS). Before homogenization, lungs were monitored visually. The homogenized lung samples were diluted and spread on 5% Sheep blood agar to enumerate number of pathogens in the lungs. The plates were incubated for 18 h. The rest of mice were monitored during 1 week to measure their survival rates (Ginsberg, Moldawer et al. 1991).

Efficacy Tests

The agar well diffusion assay was performed to evaluate the antagonistic activity of B. subtilis 281 against the growth of pathogenic bacteria including Escherichia coli ATCC 25922, Pseudomonas aeruginosa ATCC 27853, B. cereus ATCC 27348, Staphylococcus aureus ATCC 6538, Salmonella Typhimurium ATCC 14028 and Listeria innocua ATCC 33090. The antagonistic activity of B. subtilis 281 was also verified against molds such as Alternaria alternata (Fries) Keissler (ATCC® MYA-4642™), Cladosporium sphaerospermum Penzig (ATCC® MYA-4645™) and Penicillium chrysogenum Thom (ATCC® MYA-4644™). Brain Heart Infusion (BHI) Agar was used for the antagonism against pathogenic microorganisms while the Potato Dextrose Agar (PDA) was used for evaluation against molds. Reference pathogens were prepared using BHI broth 37° C. for 18 h while B. subtilis 281 was grown using LB broth at 37° C. for 18 h. Molds were prepared using PDA at 25° C. with 85% HR for 7 days. Mold spores, pathogens and B. subtilis 281 were harvested and resuspended in PBS. Pathogens and B. subtilis 281 was adjusted at optical density of 0.2 and 100 μL of pathogen suspended in PBS was spread on BHI agar plates. The same amount of mold spore suspension was inoculated on PDA. Wells were made in all the plates and 20 μL of B. subtilis 281 suspensions were inoculated in the holes while the BHI plates were incubated at 37° C. for 24 h and PDA plates at 25° C. for 72 h. The inhibition of pathogens and molds were observed as a clear zone around the bacillus strain innoulated wells and 10% hydrogen peroxide served as a positive control.

Complete Genome Sequence

The complete genome sequence of B. subtilis 281 was generated using the PacBio RS platform with single-molecule real-time (SMRT) sequencing at Theragenetex (Seoul, South Korea). Annotations were performed by merging the results obtained from the Rapid Annotations were performed by merging the results obtained from the Papid Annotaions using Subsystems Technology (RAST) server, Glimmer 3.02 modeling software, tRNAscan-SE 2.0, and RNAmmer 1.2. In addition, the contigs were searched against the KEGG, UniProt, and Clusters of Orthologous Groups (COG) databases to annotate the gene description.

Metabolite Analysis

Total protein was extracted from growth media of *B. subtilis* 281 after 18 h at 37° C. incubation to evaluate the metabolites of *B. subtilis* 281. Stock solution was prepared by dissolving 500 g of Trichloroacetic acid (TCA) into 350 mL of distilled water. 1 volume of TCA stock solution was added to 4 volume of *B. subtilis* 281 growth media and incubated at 4° C. for 10 min. Tube was centrifuged at 14,000 rpm for 5 min and supernatant was removed to concentrate protein pellet. The pellet was washed with 200 µL of cold acetone and again concentrated by 14,000 rpm centrifugation for 5 min. This step was repeated for three times and the pellet was sent to be analyzed using LC-LTQ-Orbitrap at Technopark Biocenter (Pohang, South Korea). The raw data was analyzed using UniProt database to match predicted proteins from the growth media of *B. subtilis* 281.

Example 3A

In-Vitro Safety Evaluation of Lecithinase and Hemolysis Activity

*B. subtilis* 281 did not show lecithinase activity observed as the absence of white precipitation around the *Bacillus* colonies and all *B. subtilis* 281 showed negative reaction for hemolysis as well.

TABLE 11

Lecithinase and hemolysis activity of *B. subtilis* 281 and *B. cereus* ATCC 27348.

| Strain | Lecithinase activity | Hemolysis activity |
| --- | --- | --- |
| *B. subtilis* 281 | Negative | Gamma |
| *Bacillus cereus* ATCC 27348 (positive control) | Positive | Beta |

Example 3B

In-Vitro Evaluation of Antibiotic Resistance

The agar dilution was used to evaluate the minimal inhibitory concentration (MIC) of antibiotics. *B. subtilis* 281 was found to be sensitive to erythromycin, gentamicin, tetracycline, streptomycin, vancomycin, chloramphenicol, kanamycin and clindamycin according to the European Food Safety Authority MIC breakpoints for *Bacillus* species. The determined MIC values are clearly below or equal to the EFSA breakpoint values (Table 2).

TABLE 12

Minimum inhibitory concentrations (MIC) of *B. subtilis* 281. Antibiotic resistance test

| | Minimum inhibitory concentration (mg/L) of antibiotics | | | | | | | |
| --- | --- | --- | --- | --- | --- | --- | --- | --- |
| Strain | Ery | Gen | Tet | Str | Van | Chl | Kan | Cli |
| *B. subtilis* 281 | ≤0.125 | ≤2 | ≤0.125 | 8 | 0.25 | ≤4 | ≤4 | 2 |
| EFSA breakpoint | 4 | 4 | 8 | 8 | 4 | 8 | 8 | 4 |

Ery: Erythromycin;
Gen: Gentamicin;
Tet: Tetracycline;
Str: Streptomycin;
Vm: Vancomycin;
Chl: Chloramphenicol;
Kan: Kanamycin;
Cli: Clindamycin.

Example 3C

Respiratory Tract Infection Test

Figure 9:
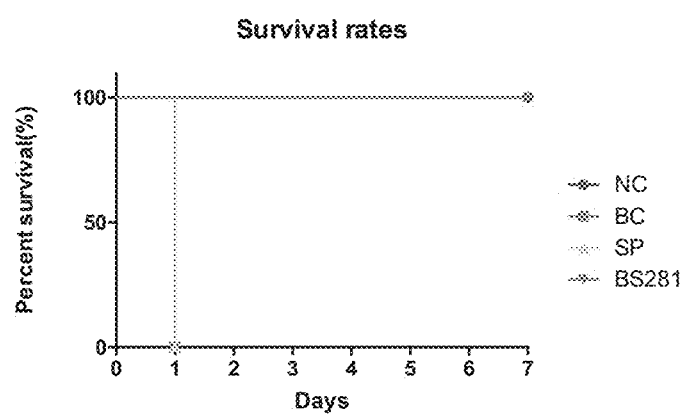
FIG. 9 is a graph showing the survival rates of mice after respiratory tract infection (NC: negative control, BC: *B. cereus*, SP: *S. pneumoniae*, BS281: *B. subtilis* 281).
Figure 10:
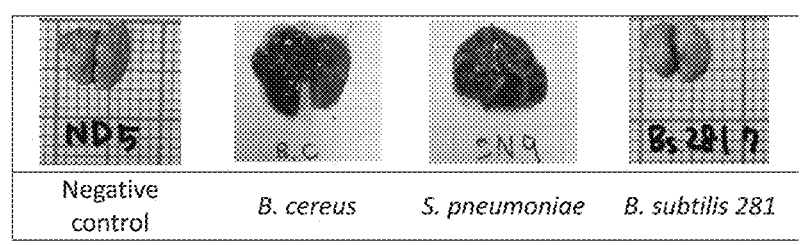
FIG. 10 is a photograph showing the appearance of lungs in each group described in FIG. 9.

The survival rate after respiratory tract infection of *B. subtilis* 281 was 100% while the positive control of pathogenic bacteria infected groups including *S. pneumoniae* and *B. cereus* showed 100% mortality after 24 hours (FIG. 9). Lung pictures were taken and showed strong damage in pathogen infected positive groups while lung of *B. subtilis* 281 infected groups showed similar lung status as negative control group (FIG. 10) and any colony of *Bacillus* was found from the homogenized lung of *B. subtilis* 281 infected group (data not shown).

Example 3D

Efficacy Tests

Figure 11:
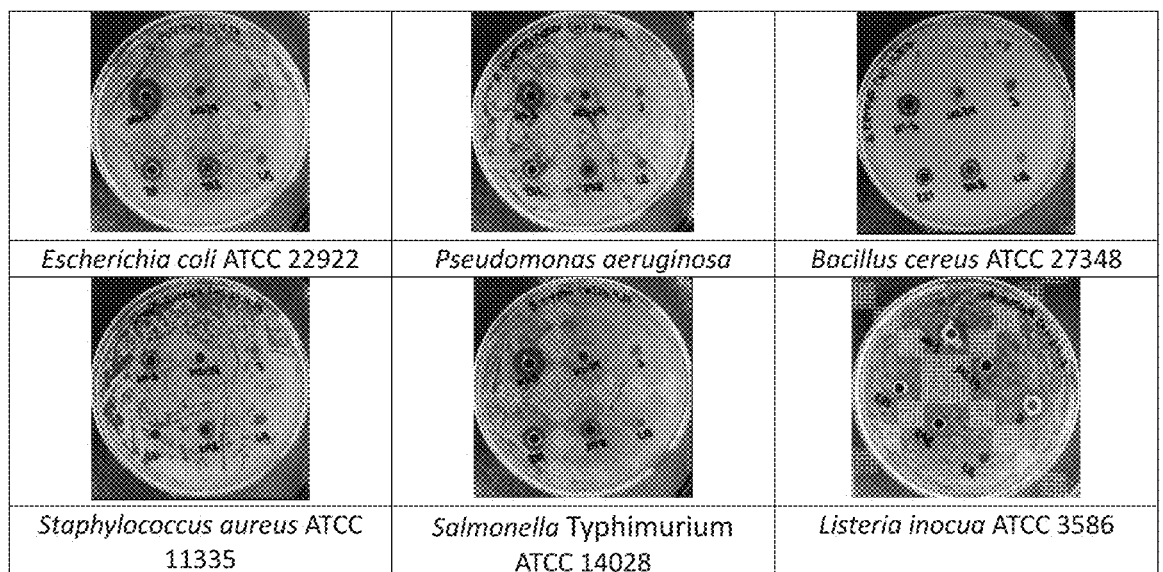
FIG. 11 is a photograph showing antagonism of pathogenic bacteria by *B. subtilis* 281.

The antagonism test results of *B. subtilis* 281 showed inhibited growth of *E. coli* ATCC 22922, *P. aeruginosa, B. cereus* ATCC 27348 and *S. Typhimurium* ATCC 14028 at different degrees (FIG. 11 and Table 13).

TABLE 13

Antagonistic activity of *Bacillus subtilis* 281 against pathogens.

| Pathogens | *B. subtilis* 281 |
| --- | --- |
| *Escherichia coli* ATCC 25922 | 2 |
| *Pseudomonas aeruginosa* ATCC 27853 | 1 |
| *Bacillus cereus* ATCC 27348 | 1 |
| *Staphylococcus aureus* ATCC 6538 | NA |
| *Salmonella Typhimurium* ATCC 14028 | 2 |
| *Listeria innocua* ATCC 33090 | NA |

NA: No antagonism was observed

Figure 12:
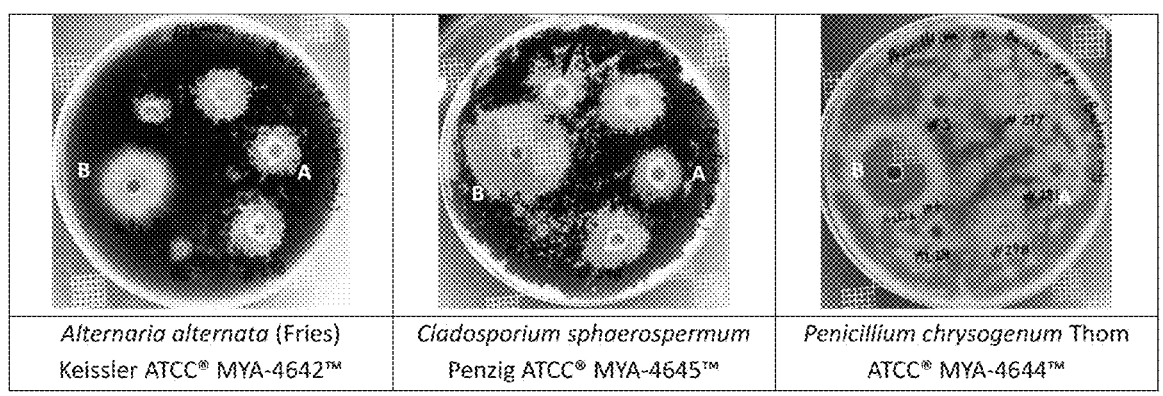
FIG. 12 is a photographic representation of results for the antagonism of test molds using *B. subtilis* 281 (A) and 10% hydrogen peroxide (B) as a positive control.
Figure 13:
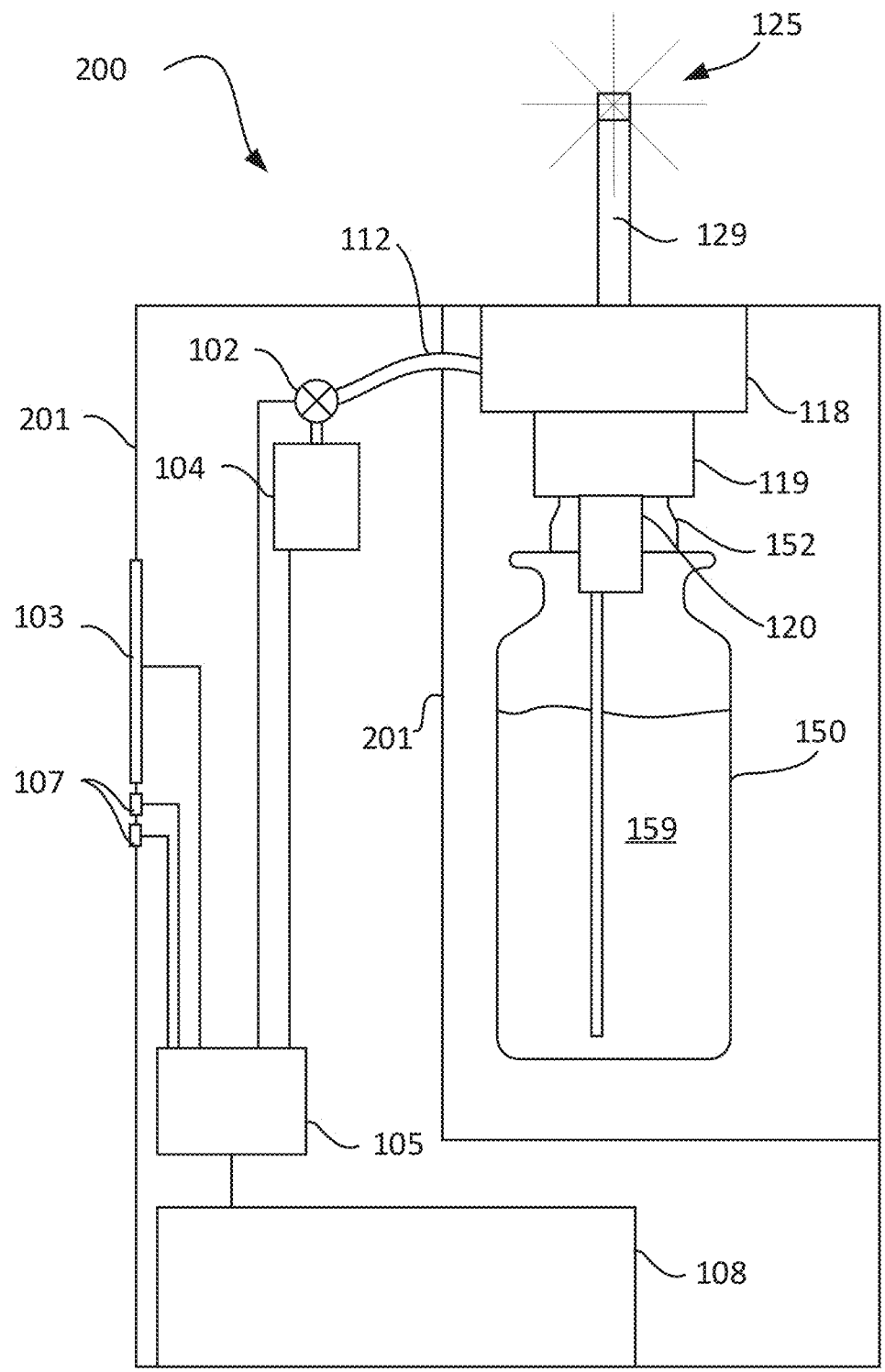
FIG. 13 is a simplified schematic drawing of an example aerosol dispensing device in accordance with some example embodiments.
Figures 14A, 14B:
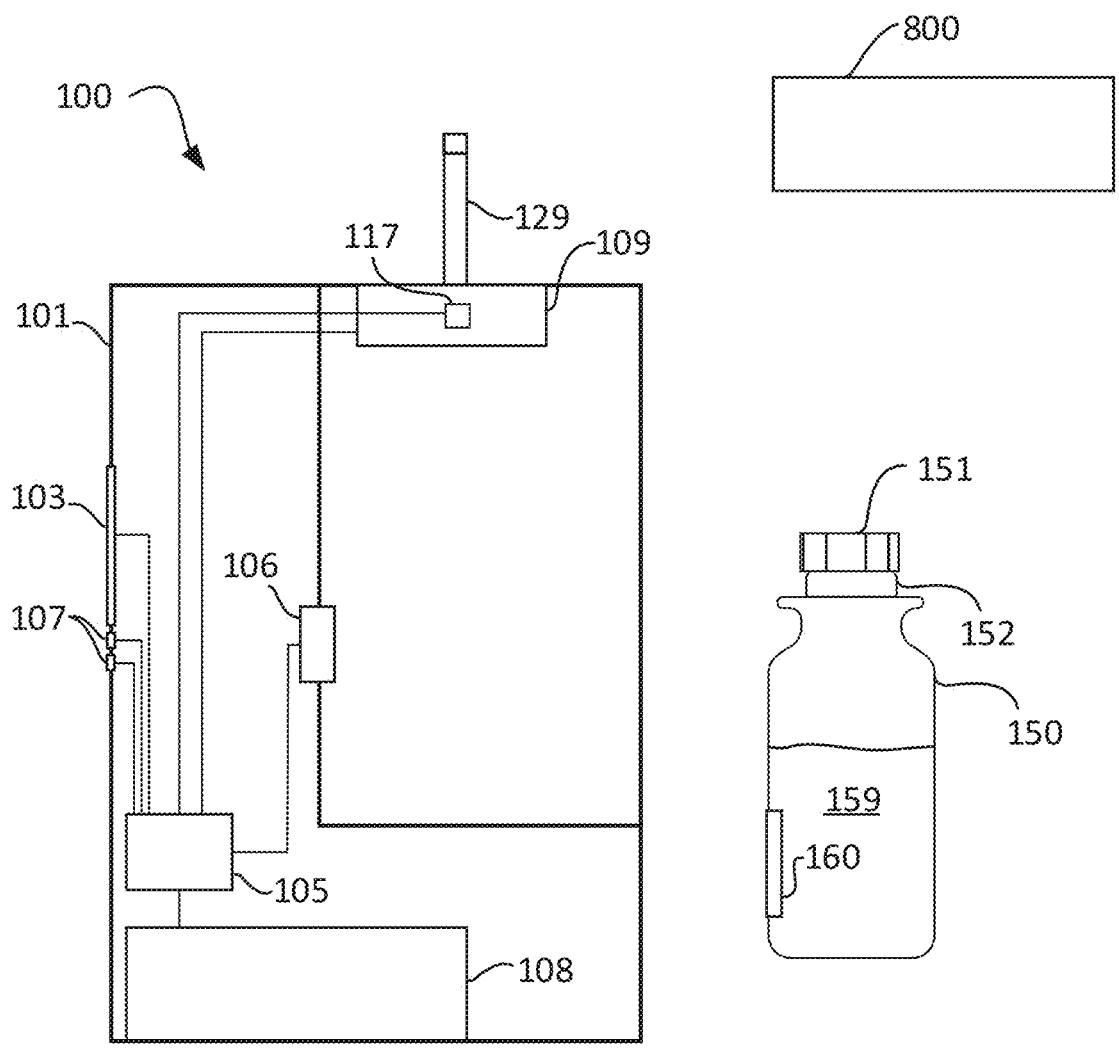
FIGS. 14A and 14B are simplified schematic drawings of an example aerosol dispensing device and an example replaceable cartridge respectively in accordance with some example embodiments.
Figure 15:
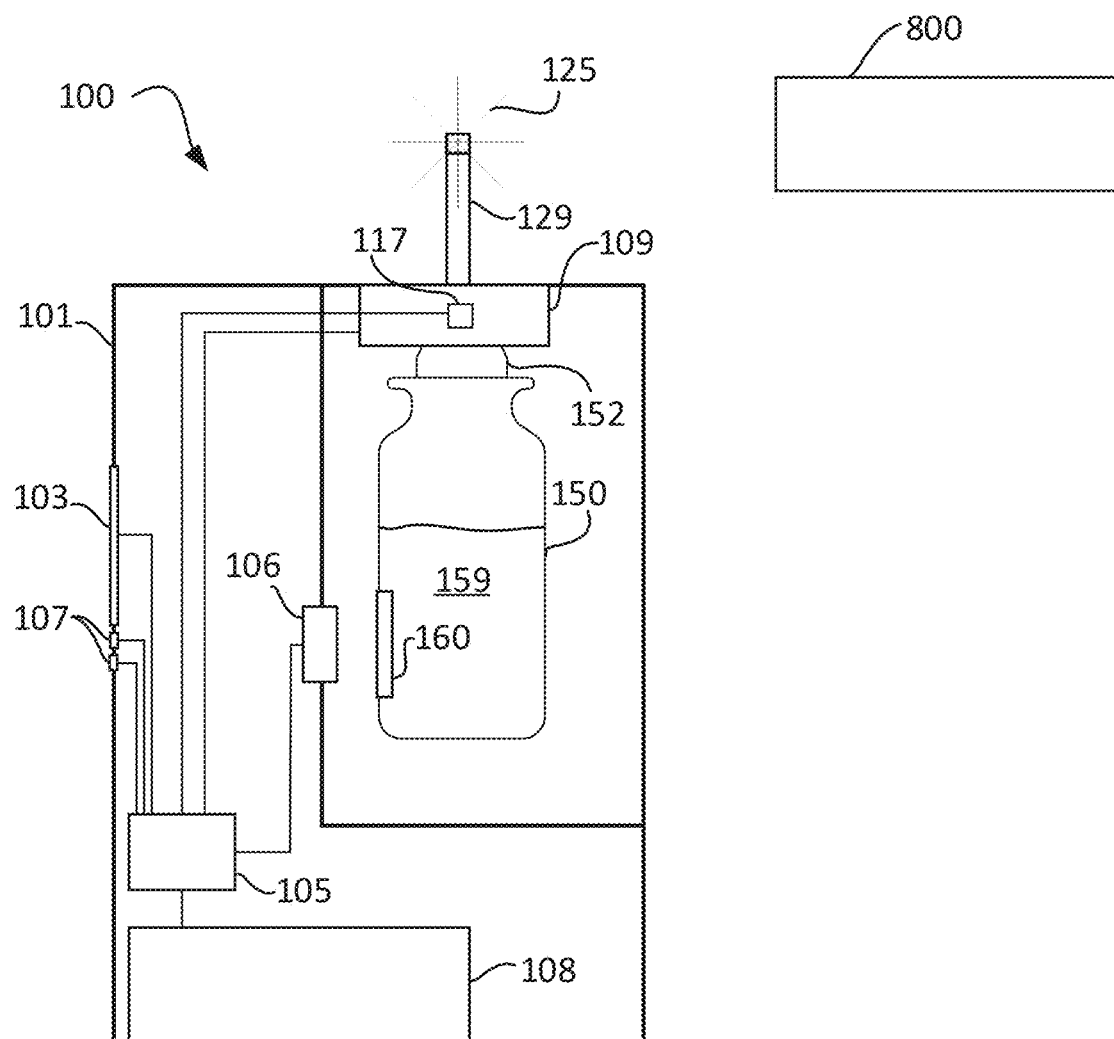
FIG. 15 is a simplified schematic drawing of an example replaceable cartridge installed in an example aerosol dispensing device in accordance with some example embodiments.
Figure 16:
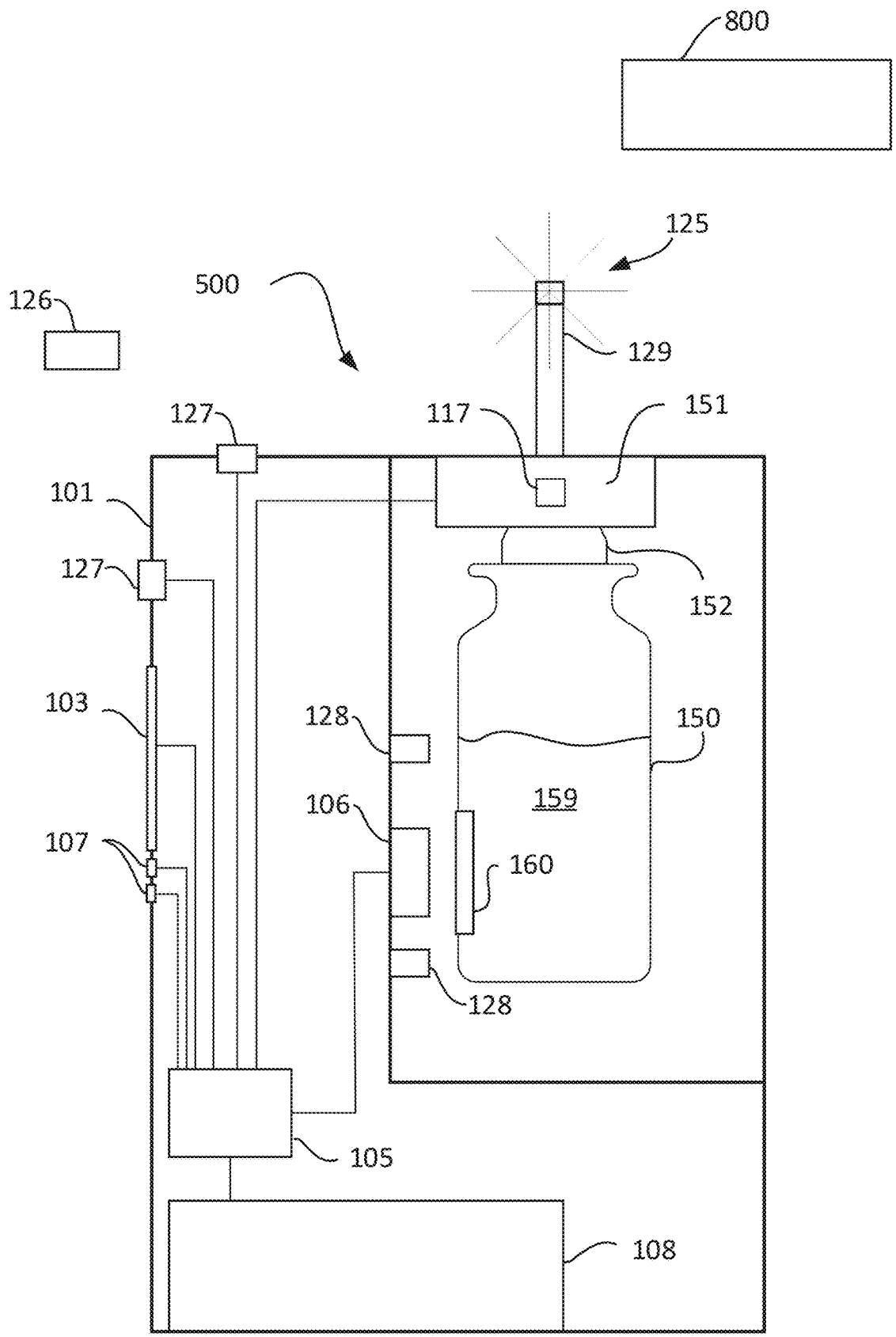
FIG. 16 is simplified schematic drawing of an example aerosol dispensing device including one or more sensors in accordance with some example embodiments.

*B. subtilis* 281 antagonism tests against mold showed positive antagonism against *Alternaria alternata* (Fries) Keissler (ATCC® MYA-4642™) and *Cladosporium sphaerospermum* Penzig (ATCC® MYA-4645™) at variable levels (Table 4). The inhibition of the mold growth is evidently expressed as a clear zone around the wells inoculated with the B. subtilis 281 (FIG. 12). Penicillium chrysogenum Thom (ATCC® MYA-4644™) was not inhibited at all for any of the strains used on this experiment, however the mycelium color around the well inoculated with B. subtilis 281 showed and slightly decrease in the intensity (data not shown) from green to white.

TABLE 14

Antifungal activity of Bacillus subtilis 281 against molds.

| Strain | Inhibition zone (mm) | | |
|---|---|---|---|
| | Alternaria alternata (Fries) Keissler (ATCC MYA-4642) | Cladosporium sphaerospermum Penzig (ATCC MYA-4645) | Penicillium chrysogenum Thom (ATCC MYA-4644) |
| Bacillus subtilis 281 | 5 | 5 | NA |
| Hydrogen peroxide 10% | 8 | 12 | 10 |

NA: No antagonism was observed

Example 3E

Taxonomic Identification

The identity of the strain was confirmed as B. subtilis according to the National Center for Biotechnology Information (NCBI) database. API results were monitored for further identification of physiological characteristics.

Example 3F

Complete Genome Sequence

Single run of PacBio provided total number of 99,139 reads which comprises in total of 917,648,089 bases. Raw data was assembled using Canu v1.6 and single contig was produced in size of 4,089,095 base pairs (Separately attached text file of "Bacillus subtilis 281.fasta"). Total number of genes were 4,365 (4,248 coding sequences) and 3,399 annotated genes were found which calculated as 80.01% of total genes (Table 5).

Lengthy table referenced here

US11602550-20230314-T00003

Please refer to the end of the specification for access instructions.

Example 4

Materials and Methods

As described above.

Example 4A

In-Vitro Safety Evaluation of Lecithinase and Hemolysis Activity

B. subtilis 3, B. subtilis 281 and B. amyloliquefaciens 298 did not show lecithinase activity observed as the absence of withe precipitated around the Bacillus colonies and all strains showed negative reaction for hemolysis as well.

TABLE 16

Lecithinase and hemolysis activity of B. subtilis strain 3, B. subtilis 281 and B. amyloliquefaciens 298 and B. cereus ATCC 27348.

| Strain | Lecithinase activity | Hemolysis activity |
|---|---|---|
| Bacillus subtilis 3 | Negative | Gamma |
| Bacillus subtilis 281 | Negative | Gamma |
| Bacillus amyloliquefaciens 298 | Negative | Gamma |
| Bacillus cereus ATCC 27348 (positive control) | Positive | Beta |

Example 4B

In-Vitro Evaluation of Antibiotic Resistance

An agar dilution was used to evaluate the minimal inhibitory concentration (MIC) of antibiotics. B. subtilis 3, B. subtilis 281 and B. amyloliquefaciens 298 were found to be sensitive to erythromycin, gentamicin, tetracycline, streptomycin, vancomycin, chloramphenicol, kanamycin and clindamycin according to the European Food Safety Authority MIC breakpoints for Bacillus species. The determined MIC values are clearly below or equal to the EFSA breakpoint values (Table 17).

TABLE 17

Minimum inhibitory concentrations (MIC) of B. subtilis strains number 3, B. subtilis strain 3, B. subtilis 281 and B. amyloliquefaciens 298.

Antibiotic resistance test

| Strain | Minimum inhibitory concentration (mg/L) of antibiotics | | | | | | | |
|---|---|---|---|---|---|---|---|---|
| | Ery | Gen | Tet | Str | Van | Chl | Kan | Cli |
| B. subtilis 3 | ≤2 | ≤2 | ≤4 | 8 | ≤2 | ≤4 | ≤4 | 4 |
| B. subtilis 281 | ≤0.125 | ≤2 | ≤0.125 | 8 | 0.25 | ≤4 | ≤4 | 2 |

TABLE 17-continued

Minimum inhibitory concentrations (MIC) of *B. subtilis* strains number 3,
*B. subtilis* strain 3, *B. subtilis* 281 and *B. amyloliquefaciens* 298.
Antibiotic resistance test

| Strain | Minimum inhibitory concentration (mg/L) of antibiotics | | | | | | | |
|---|---|---|---|---|---|---|---|---|
| | Ery | Gen | Tet | Str | Van | Chl | Kan | Cli |
| *B. amyloliquefaciens* 298 | ≤0.125 | ≤2 | ≤0.125 | 8 | 0.25 | ≤4 | ≤4 | 0.5 |
| EFSA breakpoint | 4 | 4 | 8 | 8 | 4 | 8 | 8 | 4 |

Ery: Erythromycin;
Gen: Gentamicin;
Tet: Tetracycline;
Str: Streptomycin;
Vm: Vancomycin;
Chl: Chloramphenicol;
Kan: Kanamycin;
Cli: Clindamycin.

Example 4C

Respiratory Tract Infection Test

Figure 17:
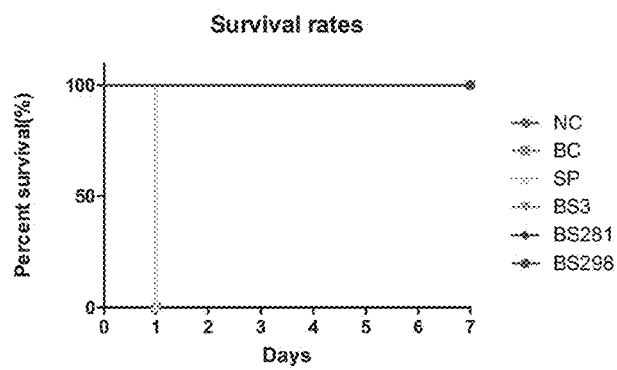
FIG. 17 is a graph showing the survival rates of mice after respiratory tract infection (NC: negative control, BC: *B. cereus*, SP: *S. pneumoniae*, BS3: *B. subtilis* 3, BS281: *B. subtilis* 281, BS298: *B. amyloliquefaciens* 298).
Figure 18:
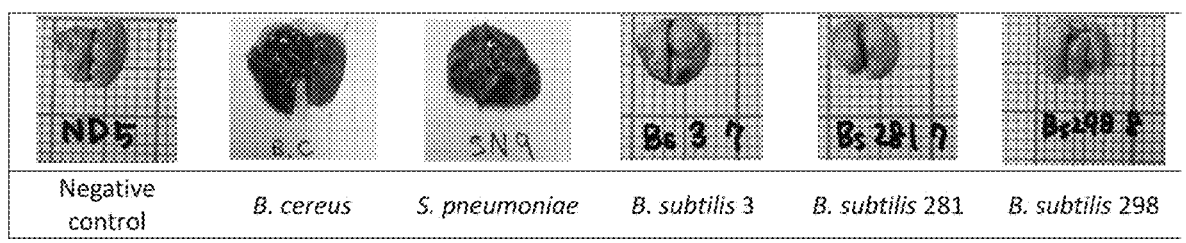
FIG. 18 is a photograph showing the appearance of lungs in each group described in FIG. 17.

The survival rate after respiratory tract infection of *B. subtilis* 3, *B. subtilis* 281 and *B. amyloliquefaiciens* 298 was 100% while the positive control of pathogenic bacteria infected groups including *S. pneumoniae* and *B. cereus* showed 100% mortality after 24 hours (FIG. 17). All lung pictures were taken and showed strong damage in pathogen infected positive groups while lung of *B. subtilis* 3, *B. subtilis* 281 and *B. amyloliquefaiciens* 298 infected groups showed similar lung status as negative control group (FIG. 18) and any colony forming units of *Bacillus* strains were found from the homogenized lung of *B. subtilis* 3, *B. subtilis* 281 and *B. amyloliquefaiciens* 298 infected groups (data not shown).

Example 4D

Efficacy Tests

Figure 19:
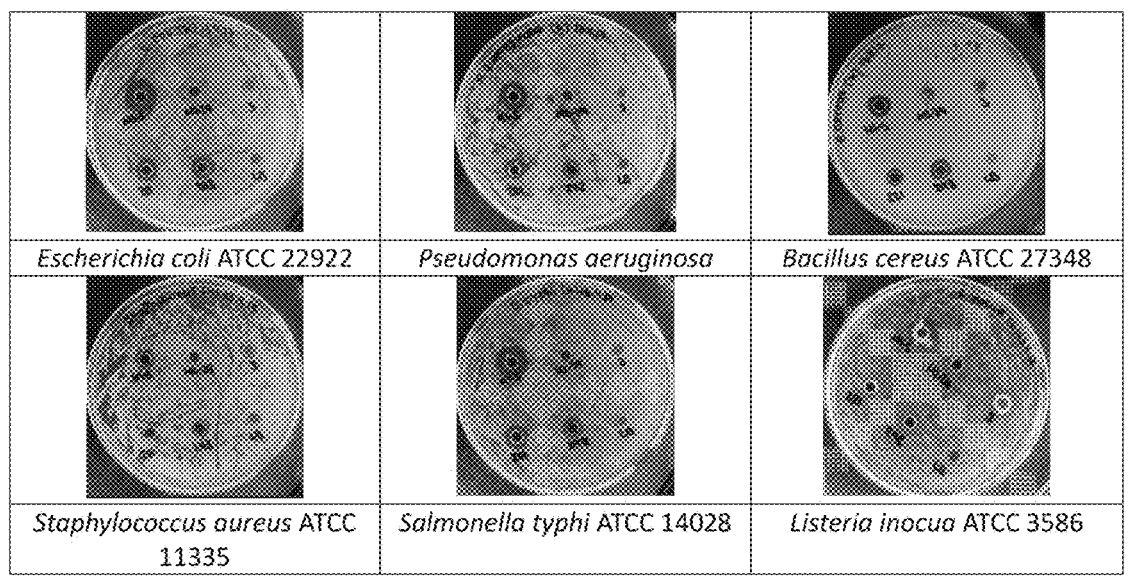
FIG. 19 is a photograph showing antagonism of pathogenic bacteria by *B. subtilis* 3, *B. subtilis* 281 and *B. amyloliquefaiciens* 298.

The antagonism test results of *B. subtilis* 3, *B. subtilis* 281 and *B. amyloliquefaiciens* 298 against pathogenic bacteria indicate that *B. subtilis* 3 reduce the growth of *E. coli* ATCC 22922, *S. aureus* ATCC 11335 and *L. inocua* ATCC 3586 at various levels. Regarding to *B. subtilis* 281 and *B. amyloliquefaiciens* 298, they seem to antagonize the growing of *E. coli* ATCC 22922, *P. aeruginosa*, *B. cereus* ATCC 27348 and *S. typhi* ATCC 14028 also at different degrees. In addition, *B. amyloliquefaiciens* 298 has also the ability of slightly reduce the growth of *S. aureus* ATCC 11335. In general, *B. amyloliquefaiciens* 298 could be more effective against pathogenic bacteria than the other two strains (FIG. 19).

TABLE 18

Antagonistic activity of *Bacillus subtilis* strains against pathogens.

| *Bacillus* strains | Pathogens Inhibition zone (mm) | | |
|---|---|---|---|
| | *B. subtilis* 3 | *B. subtilis* 281 | *B. amyloliquefaiciens* 298 |
| *Escherichia coli* ATCC 22922 | 1 | 2 | 2 |
| *Pseudomonas aeruginosa* | NA | 1 | 1 |
| *Bacillus cereus* ATCC 27348 | NA | 1 | 2 |
| *Staphylococcus aureus* ATCC 11335 | 1 | NA | 1 |
| *Salmonella typhi* ATCC 14028 | NA | 2 | 2 |
| *Listeria inocua* ATCC 3586 | 2 | NA | NA |

NA: No antagonism was observed

Figure 20:
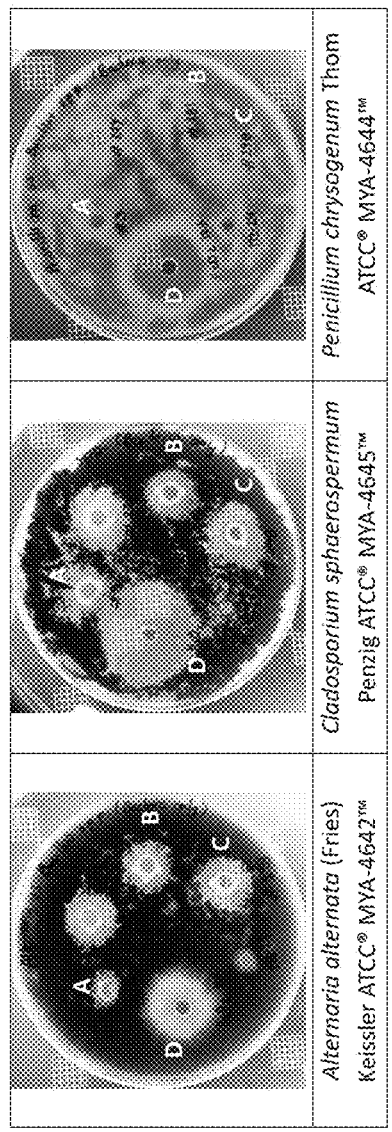
FIG. 20 is a photographic representation of results for the antagonism of test molds using *B. subtilis* strains 3 (A), *B. subtilis* 281 (B) and *B. amyloliquefaciens* 298 (C) and 10% hydrogen peroxide (D) as a positive control.

*B. subtilis* 3, *B. subtilis* 281 and *B. amyloliquefaiciens* 298 antagonism against mold indicate the strain 3, 281 and 298 has antagonism against *Alternaria alternata* (Fries) Keissler (ATCC® MYA-4642™) and *Cladosporium sphaerospermum* Penzig (ATCC® MYA-4645™) at variable level (Table 19). The inhibition of the mold growth is evidently expressed as a clear zone around the wells inoculated with the *B. subtilis* 3, *B. subtilis* 281 and *B. amyloliquefaiciens* 298 (FIG. 20). *Penicillium chrysogenum* Thom (ATCC® MYA-4644™) was not inhibited at all for any of the strains used on this experiment, however the mycelium color around the well inoculated with strains number 281 and 298 show and slightly decrease in the intensity (data not shown) from green to white.

TABLE 19

Antifungal activity of *Bacillus subtilis* strains against molds.

| Strain | Inhibition zone (mm) | | |
|---|---|---|---|
| | *Alternaria alternata* (Fries) Keissler (ATCC MYA-4642) | *Cladosporium sphaerospermum* Penzig (ATCC MYA-4645) | *Penicillium chrysogenum* Thom (ATCC MYA-4644) |
| *Bacillus subtilis* 3 | 2 | 4 | NA |

TABLE 19-continued

Antifungal activity of *Bacillus subtilis* strains against molds.

| | Inhibition zone (mm) | | |
|---|---|---|---|
| Strain | *Alternaria alternata* (Fries) Keissler (ATCC MYA-4642) | *Cladosporium sphaerospermum* Penzig (ATCC MYA-4645) | *Penicillium chrysogenum* Thom (ATCC MYA-4644) |
| *Bacillus subtilis* 281 | 5 | 5 | NA |
| *Bacillus amyloliquefaciens* 298 | 6 | 6 | NA |
| Hydrogen peroxide 10% | 8 | 12 | 10 |

NA: No antagonism was observed

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting. In addition, any priority document(s) of this application is/are hereby incorporated herein by reference in its/their entirety.

REFERENCES

1. Cho, K.-M. (2008). "Characterization of potential probiotics *Bacillus subtilis* CS90 from soybean paste (doenjang) and its antimicrobial activity against food-borne pathogens." Journal of Applied Biological Chemistry 51(6): 285-291.
2. FRANZ, C. M., A. HUMMEL and W. H. HOLZAPFEL (2005). "Problems related to the safety assessment of lactic acid bacteria starter cultures and probiotics." Mitteilungen aus Lebensmitteluntersuchung and Hygiene 96(1): 39-65.
3. Ginsberg, H. S., L. L. Moldawer, P. B. Sehgal, M. Redington, P. L. Kilian, R. M. Chanock and G. A. Prince (1991). "A mouse model for investigating the molecular pathogenesis of adenovirus pneumonia." Proceedings of the National Academy of Sciences 88(5): 1651-1655.
4. Holzapfel, W. H. and U. Schillinger (2002). "Introduction to pre- and probiotics." Food Research International 35(2): 109-116.
5. Hong, H., J. M. Huang, R. Khaneja, L. Hiep, M. Urdaci and S. Cutting (2008). "The safety of *Bacillus subtilis* and *Bacillus indicus* as food probiotics." Journal of applied microbiology 105(2): 510-520.
6. Jeon, H. H., J. Y. Jung, B.-H. Chun, M.-D. Kim, S. Y. Baek, J. Y. Moon, S.-H. Yeo and C. O. Jeon (2016). "Screening and characterization of potential *Bacillus* starter cultures for fermenting low salt soybean paste (doenjang)." J. Microbiol. Biotechnol 26(4): 666-674.
7. Jorgensen, J. H. and J. D. Turnidge (2015). Susceptibility test methods: dilution and disk diffusion methods. Manual of Clinical Microbiology, Eleventh Edition, American Society of Microbiology: 1253-1273.
8. Kong, X., G. R. Hellermann, G. Patton, M. Kumar, A. Behera, T. S. Randall, J. Zhang, R. F. Lockey and S. S. Mohapatra (2005). "An immunocompromised BALB/c mouse model for respiratory syncytial virus infection." Virology journal 2(1): 3.
9. Leuschner, R. G., T. P. Robinson, M. Hugas, P. S. Cocconcelli, F. Richard-Forget, G. Klein, T. R. Licht, C. Nguyen-The, A. Querol and M. Richardson (2010). "Qualified presumption of safety (QPS): a generic risk assessment approach for biological agents notified to the European Food Safety Authority (EFSA)." Trends in Food Science & Technology 21(9): 425-435.
10. Reysenbach, A.-L., L. J. Giver, G. S. Wickham and N. R. Pace (1992). "Differential amplification of rRNA genes by polymerase chain reaction." Applied and Environmental Microbiology 58(10): 3417-3418.
11. Sorokulova, I. B., I. V. Pinchuk, M. Denayrolles, I. G. Osipova, J. M. Huang, S. M. Cutting and M. C. Urdaci (2008). "The safety of two *Bacillus* probiotic strains for human use." Digestive diseases and sciences 53(4): 954-963.
12. Wang, L.-T., F.-L. Lee, C.-J. Tai and H. Kasai (2007). "Comparison of gyrB gene sequences, 16S rRNA gene sequences and DNA-DNA hybridization in the *Bacillus subtilis* group." International Journal of Systematic and Evolutionary Microbiology 57(8): 1846-1850.
13. Xu, S. J., D. H. Park, J.-Y. Kim and B.-S. Kim (2016). "Biological control of gray mold and growth promotion of tomato using *Bacillus* spp. isolated from soil." Tropical Plant Pathology 41(3): 169-176.

LENGTHY TABLES

The patent contains a lengthy table section. A copy of the table is available in electronic form from the USPTO web site (https://seqdata.uspto.gov/?pageRequest=docDetail&DocID=US11602550B2). An electronic copy of the table will also be available from the USPTO upon request and payment of the fee set forth in 37 CFR 1.19(b)(3).

SEQUENCE LISTING (8 sequences)

SEQ ID NO: 1 - DNA, 20 bp, Artificial Sequence
  Single strand DNA oligonucleotide
agagtttgatcctggctcag

SEQ ID NO: 2 - DNA, 22 bp, Artificial Sequence
  Single strand DNA oligonucleotide
tacggytaccttgttacgactt

SEQ ID NO: 3 - DNA, 1457 bp, Bacillus amyloliquefaciens
ggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttatggagccagccgccga

SEQ ID NO: 4 - DNA, 3928316 bp, Bacillus amyloliquefaciens (residues 1-1,964,158 of 3,928,316)
aaaaaaacatccttataaatgaaaggaaaaggctgacggagaaacagagggaaattgatgaaaccataaaacgattaaacaggaagattgaggattacgaagatatcctggaaaatgaagcgaaacttaaaaacagattgaaagctgaatgtatttctgaatgaagagaaggtgtcccgggcgccgggccgcatgaaatgtaccaagggaaacgagccttggtttttttattttctaaagagaggaaacaaaacagctttttctatcttatcaaacattacttatccttttttcagcttgactttttactgcagacttttaaagtgtgaaatgttgcttagactgtgattagcgactttaatgctgaaaagaggtggtttacccagatgaacaatcataagaatccttgggcgttattgcctttagtcttattcgtagggctttttgtcggctctggtctggtgaccggagatttttataaattgccgatcttgattgccgcgatcattgcgtcagcttttgcgctgttatttaaccggaagaaatcgctcaatcaaaaaatagaatggttcgcttccggtgcgggacatcctgatattatcattatggttatgatttttatattggcaggtgcctttgcttcagcggctgaggcgatgggagcggtgcattcaactgtcaatcttgctttgagcgttattccgcagcagtttttgctgccggggctgtttatcattgcttgttttatttctatatcgatgggaacatcaatgggcacgattgcggcggttgcgccgatcagcgcgggtctgagcggagagcttggcatctccggcgcgattacgatggcagctgtggtcggcggagctatgttcggagataatctttcttttatttccgatacgaccattgcgtcagtccggacgcaaaaaacacaaatgatggataaattcaaaacgaacttcctgattgttttgcccgctgctattttaacggttattatcttattttttattccggcaggccacgcgggccatgcgggcgctgcatcttacagctggattaaggtgcttccttatgtcgccgtgttggtttttgcgttaatcggttttaatgtgatggctgtcatattcggcggattggttttgacggggatcatcggattggcgggcggcagcctgacgtttgactcttattttaaggcgattacggatggaatcgccggaatgagcgatctgatcatcctgtccatgctgatcggcgggatggtcggcgtgatgaaacaaaacggcgggatcgactttttactggagttcatcacgaaacgaatccgttccaaaaaaggcgccgaagccggcattgccggactggtcagcgtgacgaatctggctgcggccaataatacgatctcgattatcgcagccgggccgattgcaaagaatatcgctgataaattcagcatcgacaacagaaaatcggcaagtattctggatatcttttcgtgtatgatacaaggattgattccttacggcgcgcagctgttatcagccgggaaattcgggaatatttcacccgtcagcatcctgccatactctttctatcccgttttaatcggaatctgcggcatcgccgccattatatttggactgccgaaattcacaagaaatacgaaataaaagataaaaaaaggcgccgttcggcgccttttttctttcatgacagccaagcatttctcaaaagctgtacgccctgtgcgatctgatccgtatcgagatgggcgaaacctaactttatgatcggcggttcaggctttccggcaacgaaataaacggcggtaggatatactttcactccgtactgaaaagcgcgttcgattaatgtttcttctgtatagttcaggtgaactctcaccaatatatacaatcccgactgctcgccgatgatcgtcacctgatcgccgaactgctgcttgatatgtgaagtcaagtgctgcatcttacgcttgtagacagtgcgcatgcgcttaatatggcgggtccattcaccggccttcatcaattcagccatggtcagctggttaagcgaagaagcggtgctttcgaaatgaataaaccgttttttataccggtgcaaaaggcgctgcggcaaaaccatatagcttatgcggatgcccggtagaaaggattttgagaaattccctaaataaatcacccggtctgattgaatggaagcaagagcgggaaacggctgctgtgtataacggaattcactgtcataatcatcttcaagaatataaccctctctatgattcacccaattgatcagtgtttggcgctgctgaatggacatgcttacgccgtaagggctgtgatgggatggggtcacatagattaatttttctttcattgcatgcaattgagaaaaatcagctccgttttcatagacaggcatcgtttccagagatagcccgtgaaattgaaatgccgctctggccccgtcaaacccagggtcttcaacgataattccggaaaaatcctctttcagaatccggctgagatatatcagcatctgctgggtgctgctgccgatgataaccgaatccgcatctgttttcactccgcgtgattccaagagataagcggcaatttgttcacgcaggtctctctcgccgaacggttcaccgtaaaggaagcttttctctgatgccaaaacttgattgtataattttctccatgttttcagaggaaaatgcttttgatcgacggctccggcgcgaaaatcaatcagggccggctgagttgattcggttttcttagcgtaaacaacatcgttttctttttgaaataaagaaggttctacttcatttgcaaaataacctttgcgtgtttccccgcgaatgtatccctccgctaaaagaagatcataagccatcagcgttgtattgcggcttacccgcagggaatccgccagctcccgaatcgaaggcagccgctcatctgcctgaatatttccctgctcaatcaatgttttaaattgctcgtaaatttgtttgtatttcggggtgccgcttctgaaagcgaaaatcatatttttcatcagatattctcctctgacatgtgtatttgtttgaaactgtatctttttaaatgtcagttgatatcttattatagcggaaagcgctttatcaatccatgttcagagaggagagttttgtatgtatattccggctccatttcagctgagtgaagctgaagcgtgcgatgtaatcaaagagtatggtttcgcagcattgttttcaacggcgggaggcatgccgtatgcaacccacctgccattgatgatgagtaaggataacgaatgcttatacggtcattttgcattgccgaatccccaatggaaagagattgatggccaaaacgtgttagctgtttttcaagggcctcattgttatatctcgcctaaatggtatgagacgaatcaggctgttcccacatggaattacgtggcggttcatgtttacggagaggcggagcttttggatgaggaagaaaccgtgcagtcgatgagtgatctcgtcttgaaatacgaaagccccgacagcccgtacaaattagaggatgtcgatgcgaaattgctggcaggcatgaacaaaggggtaaaaggttttaaaatcaaaatcagcaaaatagaggggcaagcgaagcttagtcaaaatcattcagccgcaagacaagggctggtcgtacaacagctcaaacagattcctcatacaaacgaacagctcatttccggcttgatggaagaaaacatcaaacggatcaccgcggacaactgacaagcatgttaaaaacataccggcagcatgcggtatgtttttttctgattatgaagcttttctcaggatgaataacgactcgaacagcacataaatcaacggcgccattaaaatgaagaaagaatgaaaaatagcatacggtatgagtaagtaaacgataagtttcaatagaatggaagacgttttattcaatgtccagcggtttttcaagatatcagtcatacaagctaaaacaaggccgaccgtcaaatatatggctgctatgtaaagataaataaaaaggtaaaacgggtaagaagacaacggaggtgtgtcttcctgtgtcatttttaaacccacataaaagaccaataaaaagcaaacggacgaaacgagagctaacaaaaggtgtttatataaatacttcttcatgtgttcacctgcctatggcgcaattatttcttaacatattatgacatggttttaccgctgctgaaagaattggaagtccggctatatgagcggggcgtaaagaatcaatatcatcttttcatgaatccggatgttttgttcggatggatgtaaagaagaatacaccaaaaaaaaagctgtcagcttggtcctgacggcttattttttgggaaaggcttatttctccgtggtgaaataaagcaatgctatgacaggaaaagcgattccaatccataatgtgatactccacccgcctgaggcgtatgcccatcctccgattgatgagcctgcagcgccgcccagaaagaagattgccataaataatccgtttaatcggctgcgaaattcaggtgccaacgaaaaaatggcacgctgactgagtacgagattggcagatacccccatatccaacaggatagctgcggccaccagaactgctattccgacgggggagctgctctgaatcatgagcgggagtaataaagaaacgatgacaacaccgagagcgattccggtggcaagccgggtcaagccgcgatcagccagacggccgcctatcggtgcagccgctgcacccgcaatgcccgctaatgcatacagcgcgattgccttttgagaaaaatgaaaagcaggaccggacaataataaaggtacagtcgtccagaataagctgaaagctccaaatacaaacgcatgataaatggcacggcggcgtaagaccggagtcgtgcgcagcagcttccacattgaaccgagtaagacggtgtagcttgtgtttgctgttggttttctggcaggaagcacttttgataagacgattgccaggacaacacttaacgcggcggataaagcaaatatggcattccacccccatatatcagcgaccagactggatatcggacgggaaagcataataccgagaagcaggccgctcatcacattgccgacaacccggcctcgtgcggcatctggtgcaaggtatgatgcgaacggaactagcacttgggctgcgatggatcccagtccgatgaaaaacgcagcggctaaaaacagtgttccatgcttcacacatgctgtcagagttagagcggctgcgcttagtaggagcgataccacgacaagttttctgttttcgataatatctcccaaagggacgagaaacagtaggccggcaacgtatccgatttgagtcagcgtgacaatcaatccggcactgcttggagaaagcccgattgccgcactaatgaatcctgccaagggctgtgcataataaagattagcgacaatgataccgcatgccgttgcgagaagaagggttaaactggttgagattctctgatctgctttttgtttgtttaacgtagccatgtgaatgaactcctttttaatgattttatgaggtttgataaatattttgctgattcatctcctctccatagatttttagtgctaaggtttgcggagtgttgagcatttactaaactgtacgtttagtttttataagtaaataatatactgaacgttcagttttgtaaataggcttctgttttatttttttatcatgttaagtatactgaacgtatcgtttataattcgggaaggaatgattcatgtgcagagtaaacgaggacggccgcgtgatgaaggaacacataaggcgattctttctgctgcctatgacctattgttggaaaatggctttgacgcggtgacagtcgataaaattgcagagcgtgccaaagtgagtaaggcaacgatttataaatggtggtcaaacaaggctgccgttatcatggacagctttctttcgaccgctacggacagactgcctgtgcccgatacaggatcaacagtgcaagatatattgatccacgccgcgaatttagcaaagtttttgacaagccgggaaggaaccgttattaaggaattaatcggtgcgggacagctggatgcaaaattggcggaagaatatcgcacgcgatttttccagccccgccgcctccaagcgaaaggccttctggaaaagggaattcagaaaggtgaattaagagagaatcttgatattgaagtaagcatcgatctcatttacggaccgattttctatcgcctgttgatcacaggtgatgaggtgaatgattcctatgtgcatgatcttgtgatgagtgcgtttaagggagttcaagctacgtgaataatcgctcgaatggggcagataatgaaaaggcagaacaaattgttctgccttctcttgcgaacgcccggcagctgccacgcacgcattcaccgctgcaagccccaataacagcccgaagaaaggctggagaagctgcagagctgtttcgttgaagcttgagccagaggtgctgtctcagcagcaaaacatttataggacgggcaggcggagcgccgtatcaatattttgtaaattaaaccggacttgttcatctgtgttccacggatgataccagcctttttccatcatatagcgtgagatttgctcgtgcatgtcgatggcttcttctaagtgacgggtgaggatcgctttcacttcaggcgttccggcttccgtcgccgccatcgcatagtttctgactccgctttttgccgaattcaataaatccatagcgacaatttggtctgtcagtgcatccatccccgtcaagtattccataatcggattcattcgttattcatctcctattcgtgctttgcatcagataaaatcgaggcaaattcctgcaattgccttgttgatgtatccgcatcctgctgcatgatttctttcagctgcggatcggatacgagcgctttcatggttttggatttcgtcagacaaagtgacttaaaagaagccatctcctgaatttcgagtaattcatgtaaggcgctggccatttctgtagcctccgttctctaaggtttgagtacaactttaatacaatcatctgttttcgtgtcaaacatctcatagccgtgcttcgcttcactgagcggaatgacatggcttacaacatcgctcggatcaattttgccggttgacaccagttcaaacatatacggcatataatggataaccggagcttgtcctgatcggatattgacgttccgctgcatgatatcgccaaggggaaacccgttgtatctgccgccgtacacacccgtaatctgaatcgttccgccttttcgcaccgcttgggacgcgatgaccaatgcgctcatggccccgccttgaagttttaatccgctggcgaggaactccagatctgtcatttttccgtccatgccgacggcgtcaatgacaacgtcggcgccgcctttggtgatttccttcaggtagctgcccgtattttcgtggtcttcgaagttcacgatttccactttattcgtccgtttcgcatgctggagacggtagttgacatagtctacggctatgacgcgtttcgctccctttaaccagcagaatttttgagcgaaaaggcccacgggcccgcagccgagaacgatgaccgtatcgcctgcttttacgccggcattgtcaacgctccaaaaaccggttgtcatcgcatcggcaataacactcaatttctcatccggttcttcgcatgtttcggggactttaaaatgggtgaagttcgcaaaagggacgcgtaaatattcggcctggccgcccggatagccgccggtactccctgaatagccgaaataagcgcccatatcgccgttttcatttgattgatcacattggctttccaggtgatttttacaataagtgcattctccgcaggcgatattaaaaggaataatgacgcggtcgccttttttgactttcgtcacgccgggaccggtttcttccacaatgcccatcggttcatgcccgataatatagtcttcctgcaagttcggaatgagtccgtggattaaatgtaaatctgatccgcaaattgccgtacttgtgacttttataatcatgtcatcgtgtttttcaatcttcggatcaggcacgtctttgactacgacgtttttcactccttgatacgttacggccttcatgctgtaatacctccagtgttagtgttcatcaggtgtgcggtcaaacatcccttttctgttcgtttcaacgggaaacagattcatgtttccgaccatgagggtatttttcgcagagagctggtccagtttatactgttcgctcagatcatgcgggtgaaaccactttttgctgaccatcaagtcggtaatttcctgatgcatcgcgattccctgcatgagctgtttgcgcagcaaagctcttacatcaggtgaagcggtttctgttaaagcgacggcggtatttctgacgccttcttttgcccgtaaaagaaaatccattgcgaatgtcatatctgcgagttcagggacgtgtaatgaattgattggatctaaatagtcatgattcaatgatgcttaccttcctttcaattaatgatcgaagtcggccggttttgaggaacaggagcctgaaaagatgcccgttcataaaccgcctgcagatcagcaaggttttgcgaggcttgctgaacgtctttttccattaacgttttcagatcctgatcaaacacaagcccttgcatgagcttggatttcgctacacaaagcgtcttgaagttaatgatttcatgtaagtccagcgactcgtgagccgctaattcacgcttttccataatcgttttttaaacctcctcttctcaattacataattaatttcccctgagaaaagagctctagtcttacaaattttgtttataaaaaaagagagaagaaatctgacggtacattaaaaaagaggaagcacaatcgcttcctcttgttcacatggaatggctgtcggtgtcctgaacgtttttctgatgcgcgggcggttttgccgcgcgggagacgagaccgctgaaacccgggaaaggtcataaaaaagatatgaacaaaagcagcccgcgaacaatcccgcaggctgttttttctttcacccgtcatgcaggacagaaggggaaggtgagaagcaggcgattatggtatgatgacaaatagaataaaacatcgtgaggccggtcggctaaaaggaagtggacagagattgtttggtacaaaacatcaagaagactatgtctcccgtgacagacgctcattgcatatgcttgcgcttcgggtgcccggtctggcgtttatttttatggtatatgccgcatcagtctctttgcagtacatttatgaaagctggacggttttattgctgctgttattcacgatattgatcgtcatttttgccgtgctgcactggcattcctatcgctgggtcaagaaaaaaacgtttctttatttcatcatacagggattaatcatatatacatcggctaacttgatgaccggcggctatatcgcggcggtcatcggtctctatgcctttttaatcgggcagattatcggaatggcggataagggcaaaacgctgctcatactctatcttttcattttaatgtccatagcagccctgcaccaggagcatccgcatcatctgcttcgtttcatcgttatcgccgctcccatcatgatcgtgattatcacgtatgcggcaacatttttcgcgcaagttgatgaaaaaatcaaaacacagatgacgcttgaaaaattagagctcgctcaccggcaagtgaaacagctgacgcttcaaaacgaaaggcagcggatggcgagagacttgcacgatacacttgcacaagggctggtcagcttgcatatgcagcttgaagcggtgcatgttcatctttcaaagggtaacactgacagagcgaaagacatcatcagccagtcaatggatagagtgaagggcacattggctgatgcgcgctcggccattgacaaccttcgcagcaaatcagaagagatcgggttcttaaaagaaagcatcactgaacaaatcaaccattttacagaagcctccgggctgtcttgttttttagattacagcgtgcatcatgtgcttgacgttcatacggcggagaattgcctttacatgattggcgaaggcctgactaacgccgccaagcatgcagaagccaagaatgtctgggtgtccgttcaggaagaagagggacagatccgcataaccgtcaaagatgacgggaaaggctttgatgccggaacagaaatgagaaaaagcggacattacgggctgcttgggatacaagaacgcgtcaatatgatgaatggcactttccgtataacaagcgccagagcagcgggaactcaaattgagatcatcataccaattcaaggagaagcggaacatgtataaagtgttaatagcagatgaccatcttgtcgtcagagaaggtctgaagcttttgatagaaacaaatgaccattacaccataacgggagaggcggaaaacgggaaaaccgccgtccgccttgcagaggaactaaagcccgatgtcattctcatggatctgtacatgccggaaatgagcgggctggaagccattaaacagataaaagagcattctgatgtgccgatcattattttgacgacctataatgaagatcatctgatgatagaaggcatcgaatcaggcgcgaacggttatctgctgaaggacacaagctcagaaaccttatttcatacgatggatgcggcggtgaggggagaagtgcttctgcagccggacatcttgcgccgtttccgggaaatgaaaatggaacgggcaaatgccaatgaaacacagctgacggacaaggaaatcatagttctgcaagccgtggcgaaaggacataaaagcaaagcgatcgccttcgatttaggaatctctgagcggacggtaaaagcgagattaacatcgatttataacaaattaggcgctgattcgcggacggaagccgtcaccattgccatgcaaaaaggcattctgaaactgaatatataatgaaaaactgcccaaacgtacatgcccctatgtacgttttttttatgtgaatgtgaactacaattaggcagaaagtaatgattggagaggagtattcgatgtctggttttttatataaattagggggatggtctgcccgcaaccgattcaaaatgatcagtgcgtggctcgtgatactgatcgcttcgattgtgatcgccatctcgttaaaacctgctttttctgaggatatgtcaattcccgacacaccttctgaaaaggcgatggatgtgattcaaaaagaattttcaaaggggcccgataaaggaagcatacgggttattttcggagctgaagacgggaagaaattgacgtcaaaaccggaaaaacaagcgattgaagagacattaaagaagatcaaaacagatcattcagtcgcttcgattgcaagtccttttgaaacaggaaccatttctaaagacggatcagtggcatatgccgatattacgtacaaaaaagcggcggatgacattacggatgcgtctgtttcacatattaaacacagtctgtccgccgccggagacaagggcctgcagacggagctcagcggcgatgtgccgggggccggtgttgaagccggcggtgtatctgaaattgtcggcgttgtgctggctttcgtcgttctggccattacatttggttcattagtcatagcggggctgccgattgtcacggccctgatcgggttaggtgtaagcgtcgcgctgacgttaattgggacacagatctttacgatagcctccgtcagtctctcattatcaggaatgatcggcctggccgtcgggattgattatgcgctgtttatctttacgaagcatcgtcagtttttgggcgaaggtgtacaaaaaaatgaatcgatcgctaaagctgcgggaacggctggcagcgccgtcgtttttgcgggactgaccgtgatcgtcgcgctttgcggattgaccgttgtcggcattccgttcatgtctgcgatgggattgactgcggcactcagtgtgctgatggctgtattggcatcagtaacgctggtgcctgcggtgttgtcaattgcaggaaaacggatgattccgaaatcaaacaagaagaaagaaaagaaaagcgccgacacgaatgcctggggacgcttcgttacaaagaagcctattctgttaagcattttcagcattattcttttagccgtcatcagtctgccggccatgcatttagagctggggctgcctgatgcgggaatgaaagcgaaagacagcccggaccgccgcgcctatgatctgttgtctaaaggattcggcgagggctttaacggcaagctgacaattgttgccgatgcaaaaggggtcaagggaaacaaaagtgaagcatttcaagacgccgtgaaagaaataaaggacttgcacaatgtggcgagcgtcacacctgccatgccgaatcaaaaaggggattatgccatcattacggcagtgcctgaaaccgggccgaatgataaggcaacgaaagagttagtgcaggatatacggaaacgatcagacaaaaacggcacccgcctgctcgtcaccgggtcaacagcggtgaatattgatatttcagaccggttaaacgatgcgattccggaattcgccattcttattgtcgggtttgcgtttgtattgctgaccgttgttttccgctcgcttctcgtgccgcttgccgccgtcgtcggctttttgctgacgatgaccgctacactcgggttatcggtattcgttctgcaggatgggaatttcaccggcttgctcagcattccggaaaaaggtccgattctcgccttcctgcctattttagccatcggtattcttttcgggctggcgatggactatcaagtattccttgtcagcagaatgagagaagaatatgtcaaaacaaaaaatccggtacaagccatccatgccggattgaaacatagcggacctgtcgtaacagcggcgggactgatcatgattttcgtctttgcgggattcatcttcgcgggggactctacgatcaaatccatggggttggcaatgaccttcggtgttcttttcgatgcgttcattgtaagaatgaccatcattccgagtgtcatgaagctgatgggacatgcggcctggtacttgccgaagtggctggataaaatcattccgaacgtggatatcgaaggccataagctgacacaaggcaaaacaccggagaaaccggaagaataaaatgaaaaagcagatcgttatgatctgctttttttatgtgctgaccgcattcatgaacagagaaaaaagctttttcatgtcttcatgtttttttgtcagcatttcgggatgccattgcacgccgacgacaaataattcacccgttcgttcaatcgcttcaatggccccgtctttcgcataagccgcggctttaaatgaaggcgccgtctcttttatgatctggtgatggaatgaattcacccgcgctgaatcgccaaacaaggaatggagacgtgtccctttttcaaaagaaacatgatgggtttttaacggcggatctttttcttgatcgtgcttaatgtcagcaaacgaagcgtgtgtcaggtcttgatataaagttcccccgtaagtgacgtttaacatatgcatcccccggcagattgccagaatcggcttttctaaagcaaccgccgtgagaatcagctccttctcgtaggcatcccgatcaggaaaggtctttcttaaagcctgtaaaggttcttcgccgtaaaacagcgggtctatatcctggccgccggacagaatgatgccgtcaacatgagagacctgttcctttaaaagcgccatctcttgaatcaccggcaatataaatggcacaccgccggcctcagaaacagactgaatataatcattattgacatatgcccgattataacccgggaaagggccggattgatcagccataatgtttcccgtaattccgatgcgtttggccatcctgcgttcacctgaacctttctttctgaaccttctcgtataaatctgaacgtaggttgtacaaatcagtttgaaattattcttcatgatatgtgaacttttcaaaaaaacccgtgacaatcacgggtttttacattcatttcaacttcttgatttcttccgtcagctctttgaacttttgatcaagctcacgatattgtttatcagccggagtcatgaagctgagttttccgaggacttcctgccgttcggtttcaagctttaatcgcagttcttcagcatcatccctgacggagggagattctttccattgttttcggacgctgccgtttgagatatcaagccggatgtccgtcgtcttttcgacaaagtaacgatcatgcgatacgatgatgagcgttccgtcgtatcgggccaaagtgtcttcaagctgctcgcgtgacggcagatcaaggtggtttgtcggctcatccagaatcagcacatctttctcctccagaataaacgccatcagcttgcatttgacccgctctcccatgctcatcttgccgatgggttccgtccattgcgctgcggtaaatcctaaatgcttcatgagggattgaacatttccccttgcttcgaacgtttctttgtaaaaaagctgttcgggggttttatcaagcggaaggtcgaatacttcctgggttaaatagccgacgtttgcagacggagaaatccatatgccgccctgcgctttttcctgaccgaggatgaccttcaataatgttgttttcccgctgccgttcgggcctgtaatcgcgatcttttcaccgtgcatcacagtgaaattcacgtttttaaaaagcgttcggccttcatatgactttgtgacatcacttacttctaaaaaacgctttcccgcttttttgcggtgctcaatggaaaaacggacttcatactccgcttcaaccggttctgctttcgctttttcaagctctttttcaagacgcttctgctttgatttaatctgggcgtccgtgcgttttgcttttacgcggtgatattctttaaagccttctattttcgttgattgggcgtgggctttttttgaccaggcgctcagctcgttcatttgagcttcaatccgtctgatcatatgctgctgattctcatattcccgctgctgtgtcagccttctctgtttgcggacctccatatagcttgaataattccctttatgttcaatgagtttctttccttcgatggcccagatttttgtcgccgccgcatctataaaagcacgatcatgtgaaacgaaaataatggtgcctttgtaattcctgatctgattcagcagtatttctaaactgtgctgatcgaggtggttcgtcggctcatctaataacaaaaggccgcttgaggaggagaaacctttggcaagacgggctttcaatttttctccgccgcttaattgcgaaaaggcgcgtgcgggcacgttccacttttctaacagggctgcctccgcaggctccgggtggccggaattataagcttccgtttcttgttccaccatatatatgttcacatcttgcatcatctggatctgtccttgtgacggcgctttttgattgcagatcaattgcagcaataaagatttgccggcgccgtttttaccgataacgccgatgatgtcgccttgctggacactcgcgctgatctgttcaaaaaggggaacgctgttgatttcataactgatgccgcttaactttaacatttctttcatatgtcaatccctcgctttaaagggaggacaaaaaaatcctcccaattgatttggaaggattagccgtacctgtgcatgatcaaataagctatttttacatagctttctcgtatcgtatagaaaatgggcagactaatcctattttttctgatttgaaatatttgatttcaaacggtcaaaataagattagttaatcattgtccacccatcatcccttcgtatttgttacgaacagtgtagcatacacttatctgtaaaagcaaagggtataagcctttttattccagattgggggcttcccactcttcttctaaaacggcataataatattcatcccaccattcattatcatgggggatgcattttttaaaaaagccttcccgcctcatcccgatcttttccattacccggtgcgaagccatgttttccggctgacatgtcgcaatgatccggtgtaatttcatctttttaaacccgaaagccagcacggcgcgcgccgcctctgaagcatatcctttgccctggtattccgggtgaaacacccagccgattacatacgtatgatcgccaaaatactgaaaaaaagcaatgtggccaatgaccgttttctcatccttcaataaaacgggaaacttcccggcatgttcaccgctgttttcagtaacgaatttcctggcatcttcttcggtaaagacaccctctggtatatatttcatgacactcggatttgaggtgtacgcatagacatcctgccaatcttccggttcaaatgtccgaatgacgagcctttcagttttgatattcatttttttatgttcctccatcaaaaaaggtttcatttactacttcgattgaaagatgtaaaaaacctttgagcggggaagagccgaataaaaaaagcctgcagctatacactgcaggcggttatttttcatttgcggcggcaggcaggtttgtaaacccgaattgccctccgacagcttcttttacttcatgaataacgataaatgatttcggatcaattttttgaacatgttttttgattttcagcaattcgttctttttaatgacaacatagataatgcgcttgtctttgctgccgtaatacccgtatccgtaaaaaatcgtcgccgcgttgccgtactcggaggtgatggctttggcgatttcttcgtattggtcagacataatggtgagggcttttttattatggaaaccctcaatgacaatatcgacgattttggcgcacagataaacgaatataaacgtatacagcatatgattgattccgatcgctaaaacggatgcgaaaatgatgacacaatccatataaaacatgcttttggagatgttaaagccctttgtgtaattcaataaatacgccaaaagcgtggtcccgccggtagatccgtcagcgataaagatcaatgccagccccgctcccatcagcagagcgccgaatacgatcccgagcaccatgtcgtgcacgccgaatggaataaagctgacgatgctgagaaaaacagaagtcattcccgtaccgagtatcgtgtataaaatcgtttttttcgttaaaaatttataagccaacccgataaaaatcaaatttacaaccagagtcgtaatacttgcaggtatatggaaaagataatataaaacgagagcgattcccacggtgctgccgtcccctaaatgattcgggatgacgaaaaattccacggacgccgcgataagaaaggctccggccataatcatcagtatatccttgcaaatgttcttcatatgcaaacctcctccgcagtcaaaaatatataaaaaacaaaaacgcctcaaaaattatccagcagaactaaataatttttaagacgaatcattcacaatctcgtttgttcattcagtaaagaatgatcagcttcaatatcgaagattatatagacaccttcacatcttgtcaatgccgtgaaaattgatttttcagcagtgtatatgaggtttgaatcaaaccaaaacgaggaatgatatcagaagagttttcatttctgctctatcaataagagaaatgtaatgagagacaacgaagaagggatgatgacattggaacgaatttttatcagtccggccaaatacgtgcagggaaaaaacgccattgaaacaatcggcggacatctggagggtgttggtgaaaaagccgtcgtcatcgcggacaaaaccgtatgggatatcgcgggccataaagtgacggctgaattaaagaaaagcaatatctcttctgaagaggcggttttcaacggcgaagcctcccaggaagaaatgaaaagaattgccggcatcgcagaaaaagcaggggcgactattgtcatcggagtcggcggcggtaaaacgcttgatacggccaaagccgtatcagatgaaataaacggctacaccgttatcgtgccgacggccgcttcaacggatgctccgacaagcgggctgtctgtcgtgtattctgaacaaggcgcgttcgaaaactatcgtttttatcataagaatcctgacttggttctggtcgatacgaaaatcgtcgcggaagctccgccgcgctttttagcatcagggattgccgatgcgatggcgacgtggatagaggcgcgcagtgtcatcgccaatggcggtaaaacgatggcaggcggaattccgacaatcgccggagaggctatcgcggaaaaatgtgaagcggtattattcaaatacggccgtctcgcttatgagtctgtgaaagcgaaagccgttacgcctgcattggaagcggtggttgaagccaatacacttctgagcggactgggatttgaaagcggcggcttagctgcggcgcatgccattcataacggatttaccgcgcttgaaggtgaaatccatcacttgacccacggtgaaaaagtggcattcggcacgctcgttcaattggcgctggaaaaacgttcgcttgaggaaattgagcggtatatcgcgttttatatcagcttggggctgcctgtcacacttgaagacatcaaattgaaagacgcatctaaagaggacattatgaaagtggcagaagccgcgacgattgaagaagaaacgattcatgccgcttttgacgtgacggctgacgacgtggcggatgccattatagcggctgatcaatacgcaaaagcatttaaagaaaaacacgcgtaaaaccttttaccgcgtgacccggaaccaagggctgttacagcccttggttttttttatgccctttgaaaacttttaaaaataaagaaaaaattatgatacaatatacaaatgttttgagagattgacaaaggaaaggtgggaacgatatgctgcataatccgaccggtaaggagcggcttgcgctggcttttctactcggaatgcttgcgatactggggccgctcaatatagatatgtatctgccgagcttccctgaaatcgccgaagatttaagcgcccgcgcttcgcttgtccagctcagtttaaccgcttgtctgatcggactgacaatcggacaggttgttgtcggcccgttaagtgacgcgaagggaagaagaaaaccgttattgctatgtatttttttatttgctttgttttctctgttttgcgcgcttgcaccgaacatttcaacactggtgattgcccgttttcttcaaggattcaccgcttcggcgggactcgttttatcccgtgcaatcgtcagagatgtgtttacggggagagagctttctaaatttttctcgctgctgatggttattaccgccgtcgcgccgatggtggcgccgatgacgggaggcgcgattttattgcttccgtttgcatcatggcatacgatttttctgtttttaacctttatcgggtttttgcttgttctcatcattgcgctcaagttgacagaaaccctgccgccggaaaagcggattccgagctccatcggaaattccgtgcggacaatgggaagcctgctgaaggatcggtcatttatcggctatgcgctgacggtcggttttattcacggcgggagctttgcgtatgtctccggaacgccttttgtgtatcaggatatttacggagtatcgcctcaggtattcagtgttttattcggcataaacggtctggcgatcattaccggaagctttatcatcggccgtttcggcgggatcattcacgaaaaaagcctgctgagaatcggcgtgattacagcgatgacggcgactgccgttctgctcgtcatgacgatcattcacgggccgctggcggcactggtgatttctatttttatttatatgattacgatcggcatgacgctgacaagcacctttacattggcgatggaaaagcagggacaccgcgcgggaagcgcaagcgcactgctcggcatgcttccgcttcttctcggttccatcgtgtcgccgcttgtggggatgaatgaagcgacggccgtgccgatgggggcaattatgttcacgacatccgttatcggttccatcgcttttttcgccttaacaacaaaaccggagaaagcaaaaaaggagtgaaatgattcactcctttttttgatgcccgctattcatatttcttcagcacgatcgccgaattatgtccgccaaagccgaatgagttggaaaggccgatcgttaacgattgatggcggggcccgtctgacacatagtccaaatcacatgccgaatcagggtgctgcagattgatcgtcggcgggatgatgccgtgtctcaggctttctgtcagagcgatggcttcaacgccgcctgccgcgccaagcatgtggccgagcattgatttgttggccgtaaccggaatgtcatacgcaagctctccgaataatgtcttgatggccaatgtttcagaaagatctccggcttttgtgcttgtcgcgtgggcgcttacgacatcaatgtcttccgctgaaacgtttgcctttttcaaagcatttttcatcgccaggtatgcacccgtcccttccggatgggaggccaccatatgatacgcgtcagagcttgcgccgtagccgagcacttcacaaaggatcggggcatttctgccgattgcgctatccaatgattccaatactaagatgcctgcgccttcactcatgacaaacccatcgcgatccgcgtcaaacggccggcttgccgcggcggggtcttcgtttctcgctgacagcgcgtgggcattgccgaagctggctaatgacaaattcgtaatcgccgcttccgctcccccggcaaacatgatatctgcgtcatcattccgaatggcgttgaatgcttccccgatcgacgtattgccgatggaacacgcggtgacgggcgaaagtgaggggccgagcgcgcctaatctgatgctgatttgagcggcggccgcgtttgagatcatcatggggacaaggctcgggctcacttttcgcgctccccgttcatttaaagtatgaacgttatcaatcaaagtcgtgatgccgccgattcccgagccgacgtacacgccgaggcgttcacggtcaatctgatcgagctgaatcccggagctttcaagcgcctgttccgctgccgctaaagcaaactggctgaaacggtcaagccgtctcgcttcttttctgccccatctttcttctgcgtcaaaatcacggacggtgccggctatttttgtcttggagccggagacatcaaacgaatcgatgagagagattcccgatgttccttccgtcaggtgtttccaaaatgtatgcacatcattgccgagaggtgaaatcactcccattccggtgatcacaactcttttcatggtcattcctccttcggtatgtatttattgtaactcgcaattatcctattacaagttgttggttatcctagtataataaataccagggtaagagaggagagattcggtatgataccagaaggaagattgcaggcgctctcagagtttttaaaaacgcagcgggccaaaatttctccgcagatggccgggctgccgatgggcacacggagaagaacgcccggactccgaagagaagaggtcgcgcaattagccggcgtaagcaccacgtggtatacgtggctggagcagggcagagacattaaagtgtccgcagccgtgttggacgcggtttccgatgcgctgcagctcaataaagatgagagaaattatttatacgcgcttgccattgaggagggcgtgaagcagccgtttaccgcggaggaagaagcggttatcagcccgtcgctttcaaaaatcctgcaggagctccgttattgccccaccattatctcggacaggcggtgtcatatcgtaggatggaatcaggccgcggctcacgtgtttttagattttgaacaaattcctcctgaaaaacggaatctcatagagctattgttttccagaaaagaattaagaagtttagccgtgaactgggagcactttgtgaaaggattcatcgccattttcagaacgtattacggccagtatgtagctgatacgtggtattctcagtttatagaagaaatggagaaaacgtattcggaatttcatacgctgtggaatgagagcgaagtcagctcggcacccgaagtattaattgagttccgccacgcgaaggcgggaaaaatggtctttaacctgacttcatttcaggttcagggcaacagtgatctgcgctgcagtgtgtatacgccggtagatcataccgaaacggaagcaaagctgaaaaagctcttcgaaaacaggtgaagaacagaaaaaaaggggaggcggccgcctcccgtttcagtttaaaataaaagcatcaaaccggcgatggccggtgttaaaaagatggctgatttcagaatgactttcggcacgaggttggtgaattttgctccgacatatgcgccgcacatcgttccgatcagcactttgaccaacagcatataatcgacaaatccttccgtcacataaccgagtcctccgccgaccgcaagcgggataatgacaagcatggtggtgccgaccgactggcggatggataagcgcaaaagaatcattaagccgatttggataaaaggagcagagccgataccgaacgttccggacaagattcctgcgatgataccgagtacaacggctttcacccatatgttcaggttgctttgccgtccggaatcttcttgtgtttcttttacaataaataaccggactaaaataagcagagcagataaaaacagcatgccggccgtcaagtaatgcagcaaatctgcggggataagggaagtaagccttgccccgaaaaacgaaccgaatgccgcaaaaacgccgacgatgaggccgattttcatctgaatattgccttcacggtagtggctgaaagcccccgataaacttgtgaaagccattccggcgagggaggtgcccaaagccgtatgaatcggtacgtgaaacagtatagttaaaagtgcaatgacaaaaccggctccccccgcgccgataaacccgagaataatcccgagaagaaacataacgagtataataagcacaatcttctcctccatttagatgcctgatcaccatgttcagatccgctttatcaggtttttaacaatcgatcgtcgtccgtcgaccgtcgtccattatctttatgttacctcaaatttgagggattggcaagaagccgaatcgcttttatacagagggtttacagctctttcaccatcactttttccccgtttgagtccagctctccattgaataagaagccgaatttttgataaagccgcaatgcgtgcacgttatcttcaaacagacttaaataaatccgtctgcactcatatattcgaacgagatggcggataagggcatcaagcaacagcctgcccaatccacgtccctgataacgttcatcaataaaaaaacggtcaagccacactctgccgttttcattttcctcatcatattccggaaaccatccgtacatggcaaagccgaccaattccccgttaacataaagaccggccggctgataatgccggcaatcctcagcatcttgtaagcactcttccgcggtttcaataaatgaagtctggctttcccttacatgaagcgccagtatatcggcacggttctcttccgtgactgctctgatttcaatcgtcatacttgatactcctcttccgcttttttctgagacggtaaagctttcatttcgtaagccatttgtgaatcagccttctctcggatacaatgatcatcataaaggatatggttaccgtatagtcaaggaggcattatgagcgaagacgtcagaaaatacttcacaacgggtgaatttgcaaaactgtgccacgtaaaaaaacaaaccctgttccattatgacgagatcggcctgctttctccggaaatcaaaaaagcgaacggatacagatactattcctatcataaattcgaactgttccaggtcatcggtctgtttaaggaggtcggggtgtccttgaagcagatcaaaccgctcttaacagacaaaacccccgaaggtatcatcacgcttttaaaagagaaatcttcagaaatcgaaagcaaaatcaaaaagctggagcacctgcaaagaatgattcagacaaaggtgaagctgaccgaacaagctttggagacagacttctcctccgtctcattgcaacgattagatgaagagacacttatgataggacgacccgtactccatttgccagaacggcaatacactgccgccatttccgaattgatccgctatatgcgggtacatgaactcgatcagggacatccggtcggcggactgtttgcgcgggagcagattctgaaaaaagaattctacaactacacccatttttatatgaagacagaaggaggcatagagaatagagacctccatatcaagccgaaagggctttatgccgtcgggtaccaaataggggatgaagcggaatcggcgtaccgcagcatcatgcagtttattgaagagtatgggctggaaatgggcgattatgcatatgaagaatatatgcttgatgaggttgtggcggacgggtttgacaatcagatcacaagaatccagctgcaagtccgcaatcgataaagccgatgccgccgttcgtttacgtcttctgacaaaccttgtataatgagaaaatcagattgcaattgaggtgaaaaacgatatgtttctagcgcccttatttgaacatgatgtaccggcagcacttctccgcccttaatggaggaaagtgactgcgcttctctccgttagggcatatgacgtgacctaatatgataacggagggtgcatcaaattgaaaaatacattgttcggttcgatttatttggcattggccgccagtatctggggcggtatgtatgtcgtcgtaaaagtagtggtagcggtcattccgccgcttgaactggtatggctgagatatgcggtggcgcttctttcgcttttgattctcagtttatttacacgccaatcctggaaagttcataaacgtgatttattactgatcgctgcgatcggattgatcggcaacacggtttcgatcgtcacgcaggaaatcggcacgaaattatcaaccgcgcagatgggtgcgattattacggcatccactcccgcatttatggttgtatttgcccggctgatgctgaaagaacggttaacgctgaaaaaaggaatatcgacagggctggcgacgatcggagtattgctcattgtggggaacggagatctcgatatgtcgagccagctcggcggtctctcgcttctggctgcggcgctgacatgggctttgatgtccgtgctgatgaaacgggttcccggccattactcaccgcttgtcgtcacaacgtattctatttgcgtcgcatttgtcatcctgaccccgtttacagcgggcccgcttcgggagattcctttgtctcagcttgcccggcctgagatatggggcggacttttatatctgggtgtgatctcaaccgcctgcgcgttcatgctttggaatcgcggattgcaattgctgaatgcggcaagcggcggtctgtttttcttctttcagccgctttccgggacattgctcggctggctgctgttgggagagtcgatcggaggaaccttctggatcggggcggcccttattgtttcaggcgtcgttctcgtcatgaaagaaaaatagaaaatgaaaaaaagccattcagcaaatgaatggcttttttctgatttcccggcaggattcgctccgccataaacagaaaacaaggagcagaaacggatcatgggcaccggtactctcaaggtgcaattcggggtttcgtcaattaacataacgggcggtgaaaaaatggagccaaaatggcttgaatgggcaaaacagcttcaatccgcggcgcaagcggggctggcttattccaaagacatatatgatattgagagatttgaagaaataagaaaaataagcgtggatatcatggcgcaacataccgggatcgacaaaaggatcatcaaagacgtattcgccggtgacacgggctatcccactccgaaagttgatatcagagcggcagtttttaaagatcagagcatattaatggtaagagagaaaagcgacggcagatgggcgctgccgggcgggtgggctgatatcgggatttcaccgggcgagaccgctgtcaaagaagtaaaagaggagtcgggaatcgacgtaaagcccgttaaactgttagctgtaatggataagaaatgccattcccatccgccgtccgccgcccacgtttacaaagtgtttatcaaatgcgagatcatcggcggccggctcagagagggaacggaaacaagcgcggccggcttttttgcggaaacggagctgccgccgctatctgccgcccgcaatacggtaagtcagattgaaaagatgtttgcatatctcaaacatccggatgaacccgtttattttgattaaggcagcaagcaggaaaaagagaggaactggttcagcaccatttcacttatgaatgatccggcctgtgatagagaagggtaaatcatcaggccgggttttaagagtctgtctgtttcggtgtggtgcaccccttaaaaaaccgtttttgaaaagtcgataatcctgcgggcagcttctgtcggtttttcctcggggacataatggccgcagccttttacctcatatccgctgacttcacgaattgattctctccatgtgtcaagcacgggaaggccggctaagttccctttttctccccacagcaaaagcgtgggaacatccagttttttctgtgattccttttctgaacgatatctcggcaaatcaatttgataagcggctctgtagtcattaagcgcagcttgaacagcgccgggctgcttccaggcggctaagtaccggtcccaggcgccgtctgatgccagcaggtcaaaaagcccgtcacctctgcttaataaaaatctaagatattcctcttcttttccttttattaattcttccggcagatggggaacgacctgaaatgtccagtgccagtatttttttgccgcttcagctgccgtcaaagaatcatagacgtattcagtcggcataatgtcaatgagcacaaggcctgccgccagctccggcgcatctaaagcgagccgccttgctactcttgcgcctctgtcatgcccggcaattaacgctttttgtatatgcaggcggcgcatcagaccttgtatatcgcctgccatcgttttgttatcatagccgtttatgccgctcggcttttcagaatcgccgtagcccctcagatcaactgcgatgactctatgagaagcggcaagcgtcggaatcacataacgccacgtcacccagctttgcggaaagccgtgcaggagaatgacggggggagcatcctcctttcccgtaaagacgtaatgaaggcggatgccatttaccttaattgaatcatgggtcacatgcttttcaaattgttcacgaaaagaatccattttctctctcctcataaaatgttatttgtttatttgagaaataatagcggaagtgacatcttccgttgaatgttttccgccggcatcaggagtcagaatgccgctgtttgtgaccgtttcaatagattgtaagaggagatggcccagttcctcttctccgaatgaatcgagcattaatttcgccgtccatatttggcctataggattggcaattccttttccgacaatatccggggcggagccgtgaacaggctcaaacatagaaggatatttgccgtttacattgatgttggctgcgggagcgattccgacgcttcccataatcgccgcgccgatatctgtcagcacatctccgaacagattcgaagcgacaatgacatcaaagcgttccggctgcgtgacaaagaaggccgccagtgcatcgatgtgctgggaatccgtctcaatcccggcgtactcccggctgacctctttaaagatgtcatcccagaacggcatcgagtgaacaataccgtttgatttcgtcgcgcttgtgacgtgtttccgccgacttgccgccagttcgaaagcataccgcatcactctttctgtaccccgtcgggaaaagaccgcgttttgtatggcgatttcgtcctcaccctgatagattctgccgccgacagagctgtactcgccctcactgttttcgcggacgactatcagatcaaaatccttcgggttaacgaggggggaagtgattcccggcaggagcttcgccggccgcacattaatcacctgttcaaattcccggcgtatcttgatgagcagcccccacagcgaaacatgatcggggacgagtttttgattccccaccgctcccaaaaacaaagcatcaaagtgctgtaacgtttctagtccatcatccggcatcatagtcccgtgctccaaataatactcgcagctccacggaaaagaagtgaaatcaaaggcaatgcctccatgtaattcggcgatcgcgttcaacacccgctccgcttgcggaacgacttctttccccacaccgtcccccggtatgctggcaatcttgtatgttttcatgtttccgtcacctctgaatgaattgttttcggtttacggcagaccgtcgaccgtcgttcgctataattccatattacgccacatccgatatgctgacaagctcgggaatgttgcttccatagataaactgttatatgatcttggtaacaataaggcctaaattgtatgaagaggtaggaaagatggataattttaaattagataagccaatcccgtattatctgcaattttattcccaattgaaaaaaatgatatttgacgggatttttaaaccgggtgaacggctgaatgagactcagctggctaaggatttcggagtcagccggtcgccggtcagagaagccatgcggctccttgaaaaggacgggcttctgacagcagacgatcgaaacggctttgtcatttattctttgtccgttaaggatgttgaagagatttatcaaatcagaatgtcacttgaatcactggcggtcgaactggttattgatgaagcggctgagagtgaaattgacctcattgaaaaacagctgcgggagacggaagaagccatcaataaaggcgtcaaagagactgagattatttccttaaacgagtcgtttcatcggcttcttgtggatttcagccgcaacagccggctggccatgctgcttgagcatgtcaatgtgctgattcatttttgcagagttcttaattttaaaggagatgaccgtgcggaggttatcctgcatgagcatcggaaagtctttgaagaaataaaaaagggcgataaaacaaaagccgtgcaatatatgacggagcatctcaagcatgatgaagaacatctgaaaggcgtgctcaaagcgggagaaacagacgaatcatcacgatagacaaggtgaaaagccttgtcttttttgccgatgtcatcgaaccgtcataaagacctgacggatgttccttgcatgattttttccgcgtcatttatgatggatatggaagagacgcaaaaaaggcaaaggagtttgaaaaatggcgaaacatattctgatgatcaattttcccgcagaaggacacgtaaacccgactttgggtatgacaaaggccttcagcgaacggggcgatcacgttcattatatctcaacggaaaaatacaaaagcagactggaaggagtaggagcgaaagttcatcttcacagcgatctgctcagaatgacacccattgatcccggcagtccgtccggcatacttgcatttttaaaggttcatatcaaaacgtcactggagattttacatattgtgcagcggctggcagaggacattcaattcgacgccgtctattatgataaattcggtgcgggagagctggtgcgggattatctcaacattcccggcatctcttcttcagcatccttcctgttcaatgaagaccgtctgaaaatactgccgctccatccggaatcgggcgtgccgtttcagccggacagggaatgtgaagagctgttggccgagatgaaagacaaatacggtgtcgcccctgacagcatggttcaatttatgaacaacacaggtgaattgaacgtcgtctatacaagcagatattttcagcccgaaagtgagacattcggagatgagtatttatttatcggtccgagttttccgaagagaaaagggcgcgtcgacttcccgattgactcattaaagaatgaaaaagtcatttatatctcaatgggaacggtgctcggggacacggaagcgtttttcaatctgtgcatagacgcgttctcagattttgaaggaaaagtagtcattgccgccggggaaaaagccgatatgtcgaaaatcaaacaggcgcccgaaaactttatcatcgccccgtacgtgccgcagcttgaagtgctggagcaggccgacgtgtttgtcacgcatggcggaatgaacagtgtaaatgaaggcattcattatcaagtgccgctggtcgttattccgcatgataaagaccagccgatggttgcgcgccgcctgactgaattggatgcaggctatacagtgcaaaaagatgaagtgagcgctgaaaaggtaaagcttgccgcggaagaagtgctgcataacggaaaatacaaacaaggcattcaagccattaatgaaagctttaaagaatgtatggacatgaaggatgttctggcccggatcgaccggtttattgaacaaaaacatgctcaataatacatggaaaaagcctgtttcctctgccaaagggaaacaggctttttataatggcttttagatgatgtgatgttcttcatttgcaagtttcacaagagtcagaagagattctgcctcacgtgcgtcgagtgtttttgccagacggtctttttcaaagatctgctggccgaagacattcactgacgcctggtcaaccgccgtgtgccagttcttttgtgaatgattctcagaaaaagagaaaacaaacacggcaaagaccgctataagcatcgccatgacccaaaatttttgccgatttcctgctgctgacataggccgcctcctaacgttcattttactggtattagatcatatatgagctgtttttcatagagtaaagaagtcattatttcaggtagtccaaatgaaacggagcacagccgaaagcccgccggtcaggccgatgagccaattcatattttgttcatattttattaaaagtttatccaagcctgtcctttacagtggatataaccacaaaacgctgctgaaaggggccttgaaaaatgcatattcatatgatcaacaaaaaccagtttgagagtgacttggaggcggccggcttcatccgtcaggcagatgatattatcggcaaaatgaaagaatacgtaacggaatacgcggcttcatccgaacggtttctgattgaaattcaaaccgtcatgaacgaatacaaagccgtcgtctgtgcgatgttttcgactatggaaattgccggtgcaaaaaaagacgagaagcatgttgagttcgaagcctgcacagtatggtgcgaataaaagaccttcatcaaacccccgcggctgcctgaacggcagtttactgactggtgttccagtaaggaaaaatattgaaacttctaaagcggctgttcgtataaaagagtaaatcagcttgtatatggaggttcgtgaaatgaacgataagaaaaaacaagcttttgaacagcttttcagcactttagacggaagacatgaaataaacggagctgtattggcagcggaaaacggccgcatcttatatcagggttcattcggcgctgcagaactgaaaacaaagaggatgctgaatgaccaatcggtctttgaattggcctcagtatcgaagccgtttacagctttaggcgttatcattttagagcagcaagggaagctgcgttatgacgatatgatagagcggtggcttcctgattttccttatccgggcattaccattcggcaactactccatcatacgtcaggattgccggactatatggagttatttttaacacattgggaccgggacagaattgccgttaatcaagatgtgatcgatatgcttaagcagcataaaccggatgcttatttcccgccgggcaaggattggctttacagtaatacggggtatgcggtgttagcggttattatagaaattgtatcaggcatgagttttgctgaatttatgaaacaagccgtatttcatccgcttcgtatgcacgatacgcggatttataacagaaggctgagtaaagaaaacattccgaactatgcatatggctatgtgtatgatgttcattccggagaatatgtgctgccggatgaacttgaggaaaccgattatgtcgtctttcttgacgggattcaaggtgacggaaccgttaactccactattagagatttatatctgtttgatcaggctctttatacggaagaaatcatcggcaaagagtctaaagatcaagcgtttacgccgggctattggaatgaagaagagcaattcggatacggatttggctggatgattcaaaacagccgccaaaaagggaaggttatcagtcacgacggaggctggccgggctattcaactctgatgatccggtatattgaccagaacaaaacactgatttatctcagcaatatggaacaatcgtatcaatttgaacaagctgtgattgccgcggccgtaaacatcttatttgatcagccatacgtgattccgaaacgtccggcggatcagaaaaaagcagatatcgatcctgcgatttacagcagatttaccggcaattactcatttcaggatgacacacatgcatcggtgacggtaaaagaaaaccgattgtatcttacaatagacgggcagacaccattcgaattattcccaatgacggaaacccgttattttgtcagggcgctgccgcttgaaattgaatttgcaggtgataaagcacaaacagccccgcatttcgttttatatcaggacggcacagaagaaacggctttgcggatagactgagtgacatgcaaaacaaaaccgccgtcctgagaagacggcggtaatagagaagtcaaacccctttgatgacgcgaaattttcttttcggctctgacataaatatagaagaaaaaatcatagctccgaccattgtgatgtattccatataaagcgaaacttctgccaaaaccaaccccgcaatcattaaaacagcgcccaataccaccgcaaaaaccttcgttttcatgatgagttcccctattatctgataattgaattatactgcatctctattaatgtgtacattttgtgaacaatttcacctgataaaaggcaataaagagagagttgaagaattaggagaaatgacaggccatctttttgttttaccgaagaaacgaaagggaaaatgaaaaatcaaaaaggcaaaggagttcttgaaatgaaagcgagactatttttattcagcatgtttctcctgatccccgttctggcgcttgccggatgcaacagccaatcttcaggaggaagcgaaaaagcgaaagacaaagaaacgcactctcacgaagacatgaatcactcaggttcatccgaggtgccgaaaggtttaaagaaggccgaaaatccgacttataaagtcggcagtgacgtcatgattttagcttctcatatgaaaggcatgaaaaatgcgcaaggaaccgtaaaaggtgcttatgatacaacggtttacagtgtatcttacactccggaaacgggaggaaagcgcgtcgaagatcacaaatgggtcattcaggaagagctgaagggcaccggtgatcaaacgttaaaaccgggtgacaaggccgtgatcgaggcatcccatatgaaaggcatgaagggtgccgaagccgttattgattcagccaaaaagacaaccgtttatatggtcgactatacaccgactgacggcggccaaaaagtaaccaatcataaatgggtgacagaagacgagcttgctgccgcaaaataaaaagaccgccaaagccgaaggaactcctttggcttttttgcggtctcacatttatgcggattttcttttcaaggcaggtctcgttaaagagaatacagctaaagcgacagcgataatgacaatcaaaccgccgcaccaggctgttgctgtgacagaaccggtttgtccgatcacgccgccgccgatggctgacccgagcgcgatgccgatctgcaaagcggacgtgttgaagctttgctgaatatcggaagactcaggcgcaattttgattaaatagctttgctgcgccggcgcaaggctccagctgagcaatccccagatcaccatcgcaggcaggaaaatgattaaagaaaccgttgtcagcggaagaataaacaggatcagagcgaaagaaacggtcacaagcatgatgcttttaaatgctcctaaacggtcatacagccagcctccgaacgggccgccgcataccgctgacagaccgaacaaaaagtagcatacactgacccaaacggaactcaaatgaagcgttctttccaaaaaaggcgcaaagtaggcatagagtgtgtaatgccccgccaatgtaaacaaggtgacaaggtgtgcgctggcaattttggcggtcccgatcgtcttgatctgctcacgaaacggaatcattttttcagcaggtattttttcaaaaaagacgctgataatcagcatggaaatgagagataatacgccgattcccaagaacagaacacgccaaccgaaggcattgctgatgataatgccgacaggcacgcctaaagcgattgcggagctgaaccccatgaaaatgatgccgatcgcccgcgctctgtattcaggcgccacgattttaggagcaatcgttaaagaaaggacgacaatcagccctgtgctcatggaagcgagcacccgtgacaccataagaacggcgaaattgggactgaaataagcgaccagattacttaggaagaaaataaacagtgcgattaaataaagccgctttcgttcagcctttgccgtcactgccaaaagcagcgggccggataccgcgtaaccgagcgcaaacacgctgatcagctgccccgcgctgacgatggatatatctaagtcggaagcgatttgcggaagaataccgcccacaattaattcaaccaatccgactgcgatggtagatgctgcaagcagaaatactttgaaattcatgtacagatactcctttttttattttttagaaaataaaaaatcctgattacaaaaagtgtacgggacaatttttgtaatcaggattttacggttcctggtagacaccctcaaaccatatcattgaggttatacaatgtatgcaatattcggctgtgtccgtttctgcaaaaaattctaccataatagtgagggagattccatagaaaattcgaggaaatcctttcaatttcaatatcggcggctgtaacgtcattgatgaagcagggaaaaaaatttatgataaccgtaaggagtctatacagatcaaacattatacagccggaggaaaccgatgaataagtacgaaaaaatcgccaacgaaatgagaaagaggattaaaagcagtgtatatgacatagatcagccgatcccggatgaaaagacgctcgctgcggagttcgggtgcagccggatgacgatgaagcgggcgcttgatacacttgcggctgaagggatgcttttcagaaaaagagggcacggcacatttatcatccaatcagccatgcaggatgagcacgttcacgtagtcagcaacgaaattctcggcttgagcaatttgttaaaaggcaaaaatatcaagagcaaggtcatccggtttgaagtgcagtttccgtctcaagatgtcgccgcacatttggccatcgatgaaaagactcccgtctattatgtagtgaggctcagaattgttgaaggcgaaccgtacgttcttgaaaaaacatacatgccggcgagccttatacccggcattaatgacgaggtgctcaaccattccatctacgatcatattacgcgggaactgcagctcaaaatcgcgggctcacacagaaaaatcagagcgtgcaagtcggatgacatggatcagcaatatctcggctgccggccggatgacccgatacttgaagtcgagcatgtaggctttttggacaacggcactccctttgaatattcattttcccgccaccgtcatgacaagtttgtcgtgacctcagtcaatataaaacgttcataaaagcgccgaagagtgagagaaaaactcactctttttttgttgccgctgatttacatcgtcgcttcttttatgttatattacccaatgatagaatcatcctacaaatttcagaggtgttttgatggagatatccaaaacaagcagactgtcgctcgtagaacaagtggtggcgcaaattgaatcgttaattcaatcggataaatggccggtcgggacgcgcattccccctgagctggatttaatgaagcaatttgatgtgagccgaaacacgttgcgtgaggccattcgggcgctcgtacatgccggcctgctgcagacaaggcaggggagcggtacgtatgtcagctcatccagtgttctcggcgcggcattttaccgccatattaaaaaatcaaatttgcttgaaacattagaagtcagatacgcactcgaaagagaagctgcacgattggcggcggaaaggcgtaatgacgaagacctgaaagcactgaaggcatgcttggatgaatgtgaagcggccttgcaaaatgaagatcgaaaacggtatgccgaagccgacattaagctgcacaaaacaattgtacaggcggcccataacaacatgctttctgatctatacgagcatatgacggaggcgctttgtgcgtcagtccataacctgttggaaatcacccctgctatccggatccacacccagcttgccgccgcgattatcggacagaaaccggatcaggccatggaggccgtcaaccaatacatcacagtatttaaagatacaatacacatggaggatgaacatgaaaattgaagacgaacatcaaattctgcaagcaagtcatcgtaaaaaactgatattgctggtcatcggagtcatattgataggggccaacctcagagcgcctttgacatcggtcgggccgctcgtttcctcaattcgggacagcctcggcatgaccaatgcggctgccggcaccattacgacagtgccgcttttggcctttgcatgtctgtcgccgtttgttcctttattgtcccggcgcttcgggaccgagattgtcttactgtcatcattaattgtcctgacagccggaactctgctgcgctccatcgccggaatcggcactctctttttcggaacgatcctgttgggattgtcgatcgccgtatgcaatgtcctgctgccgagtctcattaaacataagtttcccggaaatttaggcatcatgaccggcgtctactcggtttctatgaatctgtgcggtgcgattgcatccggcatcagcgtgccgatcgcctcttcagcggggttaggctggaaaggcgcgctcggctgctgggctatcctttcttttattgcgttcgtcatgtggattccgcaaatgcgaggacgtgaactgcccgtccgcacgactgggacaaacggagagaagaaaaacagtctgatgcggtctccgctggcttggaaggtgacgatgttcatggggctgcaatcccttattttttacaccgtcatcgcctggctgccggaaattcttcagcagaatggactcagctcaagtaaggcgggatggatgctttcattaatgcaattctcagtcctgcctattacttttatcgtgccgatcgctgccgctaaaatgaaaaatcagcgcgcactcgccggactgacggctttatttttccttatcggcattgccggcgttcttttcggaagcccggctctcactccgctatgggtcattttgatcggaattgcgggaggctgtgcgttcagtctggcgatgatgttcttcagcctgcggacccggcatgttcatgaagccgcggcgctttccggcatggcccagtcattcggatacctgcttgccgcgttcggaccgcttgtattcggtttgctgcatgacatcacgcacggctggacggttccgttattcatgctgatcgcagtctccgttctgattttcattttcggagtcggagcgggaaaagcggaacagatcaaaacagcataaaaaaacaaagggcccgtttagggtcctttgttttttgtttaaaaagctgtctcaggccgtcacgctgtcagttttaagccgatgacaccgatgaggataagccccagagacaccaattgtgacagattgaatttttctttaaaccaaagtatgcccacggccgaaacgccgatgcttcccatgccggtccaagccgcatacgcgacacctgtgggaagaacctgcatcgctccggaaaggcaaaagaatgaaagcataaagcctgttaccatgacaatcagcggccacttttttttaaaaccgtcaatatgtttcatggcaacggccgctacaacttcctccgctccggcaataaataacagcagccatgccattaatgttcaccccttgtttcagtttctttcgtaaataccttcattcctaaaatgccggacaacagcaaagccaaaaagaatatttgcccgattgaaaacgattcgcctaaaatgacgcccgttacatatgtgccgacggtgcctattccgacaaaaacggtatatgcggcagccatcggaatttttttataagagcggatcagcatcagaaagctgacggcaatcaaaaggaaaataccaatccaatcaaagagcgagtccgcatgcttcagggcggacgcccaaactacttctaacagtccggctatcaatacaagcagccaatacatgatacagtcacctcagttatgaatgaatgtcagtcatttttacggcggtcaaaaatgatcggtctccgccaatcatttctgcaagcttcttttgagaaagctgaatatttcttttttatatacttcgagatcgacatcctgttcacagccgatataaaaccgttcagccgcgttctcgacaacgttgataatcgttctggccgtccatctgacatgaatgccgctgatgacctcaccctgttcaatggccgtattgatcacgccttccagccaggaataataaggctgataaatggcttcccatttctccattgaatgatcgatggcaagaccggaataacagaggacgataatatctttatgaagccgggtgatgtgaaatgtctcatctaccaaaatgtccagcaacgtccaaaaatcttcagaaccgtccgttttcccttttattctgtccagcgtagtgtcgagcaggttttctgcaatcgcggatatcagtgcgtttttagaagaaaaatataaataaaacgtaccttgggccgttccggcttttttgacgatttctgaaatggatgctttgtctaatcctttttcagaaatgacttcaatcgcggcttgcaggatcttttcgtattttcccgagctttgttttgccaatagaggggttcctccttttatgaatgactgtcattcattttatcgcatattcgcttttttgtcaccccttaacataaaaataccggaaagaagaccatacttctttccggcattcgtcatttatcactgtcgatcatagccttcggcagacctgtatattttgcccagtaataaataccgagcgaaccgatggcgatcagaatcaggtcaagcggattgctgataatgcccaatccgtggccgaacgagccgagataggagaaaatcagcatcatgacataaaagccgacgatccaccatgctgatttcagctgctggcgtatgctgacatcatctttgggagcatatttactgaaacagagatagatcagaaacatgacaatttgagaaccgagaagccaggatacggtgcgccatccggaccaatatacaatataagaggtaaaaataaacgacagcggcccgatgatgctcatcccttttaaataaaacggtctgttaatgttcttcgcgttgactctcagcgccgcagaagaaatcggcgcaatcgcataagacagaatcaatgcgacggagcatacgttgacaagagcgttccaagaagggaacggaagcgtccaaaaaacagccagaccgaacgaaagccaaagggaggcgcgcggtgtcccggtttctttattgactttagaaaaaatgctgaataatgttccgtttctggcccaggcatagacgagacgtgaagtcgtattcataaagatatttccgttaccgcccggtgataaaatcgcatctaaaataaccaatgtcgccagccaccccaaaccgagcaaaacggcgatatctttgaacggaagggagaattcagtcccgatagccggccatccgtgcttcagggtatccgccgggatcgccccgataaaagtgagctgcagcacggtgtaaataatagtagaaacgataatacaaacaatcaatgcaatcggaatgttccgcttcggattctgcacttcactcgcgacagccacaatcggatgcagcccaaggtatgcaaacatgacgccgcctgtggaaatcgcggcctgaattccggtgaaaccaaaaggcgcgaatccgtgaacggtcatattgcccgggtgaaaatgaaaaatcagtacaacaattaccgtaatcggtacgacatatttaaaaatcgaaataatgaagtttgctttcgcaaaggttttgacactccagtaattgaggaggaagaacaggcaaagcagcgcaaattgcaatatccatccggcaattgtcggcgaatcagagccttttacggtcaaaccgggaaaccaatacgctacgtattggcggactgccgtgacttctattgaaataagactcgtgtatgccacaatggtgacaaaggaaattaaatatccgaccaggtgtccgtgtgaatatacgggataccggataattcccccggtccgcggcagcgcggcgcccagttccgcataaactaagccgatcaataagatgattcccccgccgatcagccaggaaaaaacgcctgacgggcccgctttagaggcgacgttactgacggcaaacagccatgccgaaccgaatatggctcccatgccgattaaaataagatcaaaaagtgacatagttttctggaagtttccttgcttagacattcgctgcctccttaaaaaagacattgttctctttacataattcccattatcattcaaacatacccagccggccggctggaaaattaggacaactttcgaaacgaagtatgtacagaaatgtgctcacatcaaaataacggccgtatggcaagatctcccggcttatattccccgttttgaacacattcaaacctcatattcagaaaaacaaaaaacgcccgaaacaggcgttttttgttacaagttcatatctttcagtccggggctgtgctcattcggaagctcgggaagttccgggacggggaaacctttaggaggctcggacacacttaattcgccgccgtttcggctcggcgtcgttccctgcagaatttctccgatccgtgtcggatccagtctgaaattaaattgggtattatgataacccatttcaacgaatttccggcattccgggtatttttcaatatcataattcggcacgggaaataatttgccccattcgacacccagtgtttccagcgcttttgtaaatgcattttgatgggcgttgtcacggacgatcagaaaaccgagtgtttctctgaacgtctgatttgaactcatttcataaatgcgcgtcttttgcagcacgccggttgattccagcacgacattgtccaatagatcggaaatcagattcccgtggttgtatacccaagacccgttccatggattgccgccggcgtctacaggaagagaactttgcgccccgatgataaaatggtgcggattggcgtgtttaactgcttcgtcaagcggcgcctgatctgctgcctgatttccggcgccctcagcgccgctttcatcgagcagcgcattaatcgtatgctggacgagctcaacgtgtgcgatctcttctaaaaatacaccgcgaagcaggtcacggaactgtttttcttttcctctgaaattagagctttggaaaaagtattgcatcatcgtccgcatttccccgtaatgcccgcctaaaatttcctgaagcaccttggccgcggccgggtccggcttgtccggtttaatgatattgatcagctcttctttgtaataatacataaacagcgccccctgaaagaagttttcggttcttctgttagtgtctttgcaaattcagtttttatgtatcggcatcaaaaaaaggacggaaagcgtgtccgtccttttgtgttaagcctcaaccgccccgcgaagtttcgtgttgacaagcccgttccatccttgatccatcgtactgtgaatctcggagcttttccgattgactttattgatgacggcttccggctctttccatccgccgtgaatgagagtgaattccgtatccccgctttccgtttcctttaagacaaaagaaacgatccagccttccgtatcccatgaaaaagaaaggcggtacggcgcttcaatatccagcagcttgcacggagacggaccgaacggagattccagctgaaactcactgtcttcttgaggtgtgaaatcattcggcataaaccagagagacaggccgtccgccgtagagaccgtatcccagacaacttgtatcggcgccttgaaaacggcggtatgaataatgtccggtaatggctgattgctgttgtttttgttatctttgttttgtttatcagacatgatgcgtaaccactctttcgctgtttttacttttgatcatactacacagggcaggacatttgaaaacaaatcaaacttattttatgcttttccaaagccattcaattcattttaaggagacgtagtgatgacagatcaatttaaagcgttagtagtcgatcaacatgaagaccggttttcagtcagcgtacgggagctggcggttcaggaccttcccgagggtgaagtgctgattaaggtttgctactcaggggtgaattataaagacagcttggctgccattcctgacggcaagatcgtaacctcgtatcctttcgtgccgggaattgatttagcgggaatcgtcgtttcttcagaggacgcccgttttaaagaaggggacaaagtcattgcgacaagctacggcataggcgtttcccattttggcggctatagcgggatggcccgcattccggcagattggatcgtgccgctgcctgaaggtctgacacttaaagaagccatgacgatcggaaccgccggcttcactgccgcattgtccgtccagcgtcttgaagaaaaccatgccgctcctgaaaaagggaaggtgctggtgacgggagcgacaggcggcgtcggaagctttgccgtctccattctttcaaccttaggttatgaggtcgaggccagtacgggaaaagaagaagaaagcggctatttgaagagcctcggagcaaagacggtcattcaccgtgacgaagtgtataacggcacgttaaaaccgatgcaaaaacaaaaatgggcagcggccgtcgatccggtcggaggtgagccgcttgcttcagttctcagtcagattcagtacggcggatcagttgctgtgagcggactgacagcgggaacgaaactcccggctacagtctttccgtttatattgcgcggcgtcagtctcttgggaattgattccgtattctgtccgatggagacaagaaagaaaatatggcagcgtttagctgatgacttcaagcctgcagatctggaggcctttattcaaaaggaaattacacttgaagagctgccggatacgcttcctgcccttttaaaaggagaagcgagagggagaacgattgttacaataaacaaagaataaaacaaaaacccccaatcagcagttgggggttttcaatatgtaatcaattattgattataataggggtaattcattgagtatgttatggaaataaattgatataaaacgaaaattgattatatataggtaatataaaggtgagttataaaatttcctgaaatatttattgactgaaagcgcttttaaaattatgataataacatgagtgccaataatatcattataacttcactacaaagtaactataaaataacaatatgacgagagggggagagcgaataatcactataaatgataacgctttcggaacattttcttcttatataactgttttggacggtcagaacttgtatgcagatgttagaggtgtaaatattgataactgaatattccgatattatctctgtgtaaaaactaggaggatttgaagatgaataaaaatagcagccagcattcatttttgagaaccatcattttagtatcgacattcggggggcttcttttcggctacgataccggtgtgattaatggggcgctgccgtttatggcggaagctgaccagcttaatcttaccgctttgactgaagggatggtggcgagctccctgctcttgggggctgcgatcggcgcggttttcggagggagattgtcggactataacggcagacgtaaaaatatccttatccttgccgttttgttctttgcagcgacgcttggatgtacactggcgcctaacgtatcggttatgatcatctcccgttttctgctggggcttgccgtcgggggagcatccgtaaccgtaccggcatatttggctgaaatgtcgccggcggaaagccgagggagaatggttacccaaaatgaattgatgattgtaacgggtcagctgcttgccttcacgtgtaatgctatcatcggcaatgtgcttggtgatacctctcacgcttggcgctatatgctcgttatcgcggcccttccggcggtattcttgtttttcggtatgctgaaagttcctgaaagtccgcgctggctggtttctaaaggaagaaaagaagatgctttgcacgttctccggcgaataaggaatgaagagaaagcgaagtctgagctcgctgagattgaatctgcctttcataaggaagctcagatggagcaggcgacctttaaggatcttgccgttccgtgggtgcgccgcattgtgtttatcgggatcggaattgcggtagtgcagcagctcaccggcgtgaattcaattatgtattatggaactcaaattttaaaagatgccggtttcgagacaaaagccgcattaatcggcaatatcgctaacggtgtgatttcagtgctcgcgacttttgtgggaatatggcttctcggcaaagtcggccgccgcccgatgcttatgacggggctgatcggaacgactgcggtgctgcttttgatcggagttctgtctgtcgtgctgaaaggatcgcctgctcttccttatgtggttctttcattaacagtcactttccttgcgtttcagcagggggctgtctctccggtgacctggctgatgctgtcggagatattcccgctgcgattgcgggggcttggtatgggggtcactgtcttctgcctctggatcgtgaacttcattgttggtttaacttttccgatcctgctcgcaaacatcggattgtctgcaaccttcttcatttttgtcctgttagggatagcgtccgttatatttgtgaaaaggttccttccggaaacgaaaggtctgtcgctcgaacagcttgaacaaaacttccgtgcctatgaaaaaacagatcgtaatagcgcagaagccgaggtgagcggataatctgaatagacgcggggttcctgggaatcctgctttttatttattatatagaagggaataataagcgggaaaaaaagtttcataaaagtgttgacctaatttaaagtgcgtggtatattattaaacgtcgctgatgaactaagcgataacgacaaatgagaaaatgatcttttgaaaaaagactttacaaattctcaaaagcgtgtataataaatgaagtcgagaaaaaagacttcgaaaagaaatgaaaaaacacttgacatcataactgattggtagtatgatagttaagtcgtctgataagcgcccgtagctcaattggatagagcgtttgactacggatcaaaaggttaggggttcgactcctctcgggcgcgccaattcaaatgcgggtgtagtttagtggtaaaacctcagccttccaagctgatgtcgtgagttcgattctcatcacccgctccatcataatgatctttgaaaactaaacaagacaaaacgtacctgttaattcaaagttttaaataaatcgcacagcgatgtgcgtagtcagtcaaactaaggtctgcacgatgcagatcacacagacgttactgcaggatgcagtgaacttagtctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattccttcaaaacataggaacacctgctaaatgcgccacttcctgtggcaacgcatgtgttagcatgtcctatgcgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacatagggtatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatgggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagcttttctaaaattttatcatcgcggggtggagcagttcggtagctcgtcgggctcataacccgaaggtcgcaggttcaaatcctgcccccgcaaccaaaaattaaatggtccggtagttcagttggttagaatgcctgcctgtcacgcaggaggtcgcgggttcgagtcccgtccggaccgccatttttattgtaaacgaaacgatcatgttttcgttttttttgtgttttcttttaatgctggcagcttggtatctaaccaagctttcttttatatcgttaaagtcttggatattgaaacataatccgatacactagaaagagctgtatttcacaagagcgtcagaaagggagacgggagatatatggatgagtttgagttgattcacagtattacgccgcattcgcattatcatccttccgtcgatgtagggatcggtgatgatggtgcggtttatacagcgtcaccccatatgcagcaaattgtctgccttgatacaatggtggagaatgtccattttaaattagagtattcctctcctcatgatatcggttataaggcgcttgctgttaacattagtgacgttgcggcgatgggaggcattccgaagttttatttggtgtctctagcggttccttcttgctggcagaaagctgacgtccaggcaatgtatgaagggatggcggaactggcgaaactataccaaatggatttgatcgggggagataccgtctccgcttccggtcaagccgtaattaccgttactgtcatcggtgaagttgagaaggattgcgcttgtctgcgaagctcggcaagacccggagatgttgtgtttgttacgggggatatcggctcgtccgcagcaggactgtctcttttgttgggagaaacacttccttctgcttttcacacgagtgattattttatccgaaaacataaacggcccgttccgagagttcaagtcggccgcttctgctctcagcttcagcgcgcggctctgaatgatatcagtgacggattggccagtgagctgcatgaaatagctgcggcaagttcagttacgatagaaattgaagaacaacttctgccggtgcatccggatttgcctgaggcagattccgagtggaagaaatgggtgttattcggcggtgaagattttgaattggttggaacggtttctcagcaagagtggatttctctgcttgattactgcactcaatcgggcattccgattgcgaagataggagcggtatctgaacggaaggaagcatgtgttcttttgacagccaatgatcagagacaaatcgtccttgagaaaaaaggatacaatcattttaaataagacgggtgactcactttgaagacattacaatggagaacgaaaaaccccgaagaaacgaaagccgtagccaagcttgccgcttctttggcaaagccgggagacattttgacactggaaggcgacttaggcgcgggaaaaacgacttttacaaagggttttgccgaaggactgggaatcacgagagtggtaaacagcccgacttttacaattataaaagaataccatgacggttcgattcctctatatcatatggatgtgtatcgtatggaggatgaaagcgaagacttagggcttgaagaatattttgagggacaaggcgtctgtttaattgaatgggctcatttaattcaggatcagctgcctgctgaacggctgcagatcgtcatcaagagagccggtgatgaggcaagggacattacctttacggctttcggaatacggtatgaaacgctttgtgaggagataaataaacatgacaatactggcaattgatacgtcaaattacacgctgggtgccgcgctcgttcgtgacaaaacggtgatggcggagtatattacatatttaaaaaagaatcattccgtgcgggcgatgcctgctgtcaattcattgctgaaggattgcggcctaacaccgcaggaccttacgaaaatagcggtggcgaaaggacctggatcgtacacaggtgtcagaatcggtgtgacgctggcaaaaacattggcatggtcgctgaagcttccggtttccgctgtctcgagcctggaggtggtggcggctaacggacggcactttcaaggactgatctgcccgttatttgatgcccggcgcggacaggtatatacgggactttatgaatatcaggacggccgattacaatccgttcttcctgatcagaatgtccttttgactgattggctcggcatgctgaaagaaaaagcgtctccggttttatttttaggacacgatacagccattcatgaagaaaccattctgcatgaattgacatctcaagcagtgataggaacggctgcacagcataatccgcggccgtcagagctggcgtttttaggcttggaaaaagaagaaacggatgtccacagccttgttccggattatttgcgtctggcagaggctgaagcgaaatggatggaatctcaaaaatagggtgatagggatgaaaacgaaaacggcgattcgaagcatgcggccggaagatattgatcaaatttatgaaattgaaacagcatcctttacttctccgtggacgaaggattcattttatcatgagcttttggaaaatccgtatgcccactaccttgtcattgaaaaggacggctgtctggcggggtattgcggaatctggattattatagatgacgcgcagattacgaacatagccattaagccggaatatcggggccaatcgttgggagaagcgctgtttcgctctgcgatagaattgtgcagagaaaaaaaggcaagaaggctctctctcgaagtcagggtctcaaatcatcccgcccaatccttatataagaaattcggtcttcaggccggaggaatcagaaaacaatactatacagataacggggaagacgcgttattaatgtgggtgacattacatgagtgaaaaacaagatatttatgtattaggaatcgaaacaagctgtgatgaaactgcggcctcagtcgtgaaaaacggaaaagacatcatttcaaacgttgtcgcttctcaaattgaaagtcataaacgtttcggcggagtcgtgcctgaaatagcgtccagacatcatgtggagcagattacccttgtgattgaggaagctctttcaaaggcggagatgggctttgatgatcttgatgcgattgccgtaacggaaggacccggacttgtcggagccctgttaatcggggtcaatgcggcaaaggcgttaagctttgcccatcaaataccgttagtcggcgtccatcacattgcgggccatatctatgcaaacaggctgataggagagcttcagttcccggcgcttgctttggttgtgtcaggcggacatacggaattggtttatatgaaagagcacggttcattcgaggttatcggtgaaacgctggatgatgccgcaggcgaagcttacgacaaagtggcaagaacgatggggcttccctatccgggagggccgcagattgataagctggctgctgtgggaacggattccattccgcttccgcgtgcgtggctggaagaagggtcttacaatttcagcttcagcggcctgaaatcagccgtgattaacacgcttcataacgcctcgcaaaaaaatgaggtgattcctccggaggatcttgccgcaagctttcagcagagtgtcattgatgtactgacggcaaaaacctctaaggccgcgaaagaatatggggttaaacaagtgctgcttgcaggaggcgtagccgctaacaaagggctgagagccgcactgcaacaggaattcagccattcgggagatcccgagcttatcatcccgccgctttctttatgcacggacaatgcagcgatgattgcggctgccggaaccgttgcttttgaaaaggggatccggggctcatatgatatgaacggacagcccggtttggaattaacatcctttgatcgtctcacgttgtaaaacgtgaggctttttttacttattaacagataattctaacatatccacaggattgtgaatatattcagaaatccagtctggataagggactgaaagttgttagtaaagtggataaagtcagaaaattttgtggatagtgtgtataaaacgcttacttaaatggctgacaaggaggatagctgtggataaaaaagcaccccttaaagaggtgcttgactttttctattcttctgaggagagttcctcccattctgctaataagttttcgagctcttgattcagggcttcattctccgcgtgaatggtctgtactttttcatgatcctgatacacgtcagggtcgcacagcagctcctcattggcactgattttctcttcggcggatgagacggccgcttcgatttcttcaatgcgtctcaggcgctgccgttctttcttcttccattctttttcttcctcgtaagttcttttcgtatcctgtttgaccttgccggcaggctgagcctgctctttttcctgccgtttcatttcttccagttccagctgctgggcttttttctcggtgtaatagtcatagtcacccaaatattcttctgcatgatcaggtgacagctccagcactcttgtggcgatcctgttaataaagtagcggtcatgcgatacaaataacagtgttcccgggtagtcgatcagggcgttttccagcacctctttactatccaggtcaaggtggtttgtcggctcatcaaggatgagaaagtttgctttttgaagcatcagcttggcaagcgcgactcttgctttctccccgccgcttaacgaacggaccggtttcaggacatcgtctccgctgaacagaaagttgccgaggcatgttctgatttctttttccggcatgtccggatattcatcccacagctcgtccagcacgcgtttggacgatgtcagttcagcctgctcctggtcgtaatagccgattgtgacattggaaccgtacgtgatcgacccggattccggactgatcgtgttcataatcgttttcagcaaggttgatttgccgattccgttcggtccgacgagggcggcgctttcgcctcttgtaatgccgaaggtcaggtttttcaagagcggcggctggccgtcatagctgatggaaacatcctgtacgcgcaggacgtcgtttccgctctgttttgtaatgtcaaaacggaaggcggcggatttctcatccccgagcggcttggccatgacgtccatccgttcaagctgttttcgtctgctttgggctcttttcgttgtagaagctctggccagattgcggtcgacaaaatcttgaagcttggcgatttcgtcctgctgtttttcatacagcttcaggtctttctcatactgctcggctttttgttctaaataggcgctgtagttgccgaggtattttttgctttctgtccgggagacctcgtacacttggctgacgactttatcaagaaagtatctgtcgtgggaaacgatcaggattgcgcctgaatatccctgtaaataatgctcaagccatgtaagcgtatcgatgtcgagatggttcgtcggttcatccagaataagcagatcaggctgggtcagcagcagttttccgagcgcaagccttgttttctgaccgccgctcaggctttgcactttcacggaatcgtcaaattttccgaagccgagtccgtgaaggatagatcggacgtccgcttcatattgatagccgcctttatccttgaaatcctgctgaagcctgtcataggttttcatcagcgtctcaagctccgccggggcggccgtggccatcttttcttcaatagagcgcatctctttttccattgctttcaggaaatcaaaaacgctcagcagttcttcttttatggtaagctgggattccaagccagtgtgctgggcaagatatcccatcgttaattctttcggtttgattaattcacccttttcatatgaaaggtgacctgcgataattttaaggagagttgatttgccggctccgtttctgcctactatggcgatgcgatcccgagatctgacttcaagctttatattgtttaaaataggatcagcgccaaaagatttggatagctgattaatttgtaagatcatcatattatttcacctctgttataataagttaagtgtagcttatcaacctgctgtcagcaaacaatacattagaattggaacattataggataagacatcagggagaaaatagtgtatgatcagaagtaaggagagtttaaatatgaatggattttctcattttaatgaagaaggccgtgcccgcatggtggatataagcgataaatcttcaacagtccgtactgccgctgcgatatccagcgtacacatgaagcatgacgtgtacagcagaatcaaaaaccgcgagatcggaaaaggtgacgtgctggctgtcgcacaggtggcaggaattatggccgcaaagcagacgtcagcgattattccgatgtgccacccgctttctttaagcagcgtcgacatttcattcggctgggaggaaaaggattccgaagccgttcttcatatacaggcaagcgtaaaaacgaaagggagtacaggtgtggaaatggaagcgctaacttccgcttcagtctgcgctttgaccgtgtatgacatgtgcaaggcgctggataaaggaatggtcatcggcccgacctgcctcatggaaaaaacaggaggcaaaaacggtgattttaaaagagatgcatctgagtataaagtggaggaccaatcatgaacaaggatcaatcaaaaattccacaggcgacggcaaaacggctgccgctttattatcgctttttaaagaatttacacgcctcaggaaagcagcgcgtttcatcagctgaactgagcgacgcggtaaaagtcgattcggccacgatccgccgggatttttcctatttcggggcgctcggcaaaaaaggatacggctataatgtggattacctgctgtcatttttcagaaaaacactggatcaggatgaaacgacgaacgtcattttgatcggtgtcgggaatttagggacggcgtttcttcactataatttcacaaaaaataataacacaaaaatatctatggcttttgatgtgaatcagagtaaaataggaactgaggtaggcggtgtgcctgtctttgatcttaatgatttagagcttcacataaaggatgaacccgtggcgattcttaccgttccggcggttgccgcccagtcaatcaccgaccggctcgtggcgctcggaatcaagggaatccttaactttacgccggcccgtttgaatgtgccggatcacattcgaattcatcatatagatttagctgtagagcttcaatcattggtttatttcttaaagcattattctgttttggaagaaattgaatagcgaaaggaggagctgcacatgatcggtcctggaagcctggcggttatcggtgtggtggcggtgattattttcggtccgaagaagcttcccgaattaggaaaagcggcgggggacacgcttcgtgaatttaagaacgctactaagggattagccggtgaagaagaggaaaaaaagaaagaagaacagtaagataggatgacgcgtatgagagtgaatcaaatgacgcttgtggagcatattgccgaacttcggaaacgattgctgattgtggcgttatcctttacggttttctttattgccggcttttttctggcaaaacctatcattgtgtatcttcaaaaagccgatgaagtaaaagagctcacccttaatgcttttaacctgacggatccgctgtttatctttttgcagttcgcgtttatcatcggcatcattttgacttcgccgattattctctatcagatttgggcgtttgtcagcccgggtctgtatgagaaggagcgcaaagtaacactcagctatattccgatttcgatcgtgctgtttgtcggcggtgtgtcgttttcttattatattttatttccgctggtcgttgattttatgaagcgggtctcgaatgacctggatgtcaaccaggtgatcgggatcaccgaatactttcattttctgctgcagctgacgattccgttcgggctgctgtttcagatgccggtgctgatcatgtttttaacgagactcggtgttatcactccgatgtttttatcgaagatcaggaagtacgcatattttgtgctgctcgtgatcgccgcgatgattgcgccgcctgagctgctgtctcacttgatgattaccattccgctttgcattttatacgagatcagtatcctgatttcaaaagcggcgtatcggaaaaggcagaccggcagtgaatctgaccaggacgtatcagcataaaaaaagccatttctcaatgatgagaaatggcttttcttttattatttttgatttttcttcactttaaatgagaaggcgaacattttaaacgagatgctgatattataagcggcgaaaaccatcagcagtatggaataaaaagaccacatgcttcccggagagcttgcggccaaatacgtaaagatacagccgactgcgaaataaatcaagccccaagtcattgggttcctcatacaaacaatcctccaataattaattgcatttgctcactatgctgttcaatatatttttgggcggggccgagctgcatgaccacgacaatggtattcatcatgacatgggcgaatatcggcacaataatccgtttcgtctgcacatacaagaacgcaaaggtaaagcccatggccgtatacagcagcaggtgcgtgaggtcttgatgcacaatgccgaaaatgacggaactgatcagtccggcgataaagaaattcgttttttcatataatacaccgaagatgatcttccggaaaatgatttcttcaagaatcggcccgacgatagaagaaacgataatcatgagcggcatggctttaataatgttgagaatggctttcgtgttttcggaaccgctgtccacgtgaaagacatactgctcaatcatcccggcgattccctgagaaaataaagcgagccatattcccgcgaccgcccagagaacggacatgccggcggatgctttcttcccgtttcttaatgtctgcttcggcgcggttctcaaaatcaagagaacgataatcaggcagataaaaaagcttacgacggaataaatcccctgagccatggtgagattcgcattcgtagggtgcccgcccgcatagccgaatttgtacattaaaggaatgccgatcaatgcggaaagctgcatgataacatatgtcaaaatgatataccaatactgttttctcaaatgatatgtactcctttatcctataaaatcaacttatttgttcttattgtaacacaagtgaacttgccgtgaaaaaaggagaaaatcagtgtgagagagaatcatgtaagcgtgaaaattttttattcttatgacttgaaattggaagtgagattctttattataataactgtgttagcactctttagagctgagtgctaaaattacatattcatactattgaggaggttattacattgttaaagccattaggtgatcgcgttgtcattgaactcgtagaatctgaagaaaaaactgccagcggaatcgtattaccggattctgcaaaagaaaagccgcaagaaggcaaaatcgtggcagccggttcaggtcgcgtgttggaaagcggagagcgcgttgctttagaagtaaaagagggcgaccgcattatcttctcaaaatacgccggtactgaagtgaaatacgaaggtactgaatacttaatcttacgtgaaagcgacattttagctgtaatcggctaagcaaataaatatttttaaaaattcgaggaggtttcgttaacatggcaaaagatattaagtttagtgaagaagcacgccgcgctatgcttcgcggtgtcgatgcgcttgctgacgctgtaaaagtaactttagggccaaaaggacgcaacgtggttctggagaaaaaattcggttctccattaattacaaatgacggtgtgacaatcgcaaaagaaattgaacttgaagacgcgtttgaaaacatgggtgcgaagcttgtagctgaagtagccagcaaaacaaacgacgttgccggtgacggtacaacaactgcaactgttcttgcgcaggctatgatccgtgaaggcctgaaaaacgtaactgcgggggctaaccctgtcggcgtacgtaaaggtatggaacaagccgtaactgtagcaatcgaaaacttaaaagaaatttctaagccgatcgaaggcaaagagtctatcgctcaggttgctgcgatctctgctgctgatgaggaagtcggaagccttatcgctgaagcaatggagcgcgtaggaaacgacggcgtcatcacaatcgaagagtctaaaggcttcacaactgagcttgaagttgtggaaggtatgcaattcgaccgcggatatgcatctccttacatggtaactgactctgataagatggaagcggttcttgacaatccttacatcttaatcacagacaaaaaaatcacaaacattcaagaaatccttcctgtgcttgagcaagttgtacagcaaggcaaaccgttgcttctgatcgctgaagatgttgaaggtgaagctcttgctacactcgttgtcaacaaacttcgcggcacattcaacgctgttgccgttaaagctcctggcttcggtgaccgccgtaaagcaatgcttgaagacatctctgttcttacaggcggagaagtaatcacagaagacttaggccttgacctgaaatctactgaaatcggacaattgggacgcgcttctaaagttgtggtaacgaaagaaaacacaacaatcgtagaaggcgccggcgacactgaaaaaatcgctgcacgcgtcaaccaaatccgcgctcaagtggaagaaacaacttctgaattcgacagagaaaaattacaagagcgtcttgcgaaacttgccggcggcgtagctgtcatcaaagtcggcgctgcgactgaaactgagctgaaagagcgtaaacttcgcatcgaagacgccctcaactcaactcgcgcagctgttgaagaaggcatcgtatccggcggtggtacagcgcttgtcaacgtatacaacaaagtcgctgcagtggaagctgaaggcgatgcgcaaacaggtatcaacatcgtgcttcgcgcgcttgaagagccgatccgtcaaatcgcacacaatgcaggtcttgaaggatctgtcatcgttgagcgcctgaaaaacgaaaaaatcggcgtaggcttcaacgctgcaaccggcgaatgggtaaacatgatcgaaaaaggtatcgttgacccgacaaaagtgacacgttctgcacttcaaaacgcagcttctgtagcagcaatgctcctgacaactgaagccgttgtcgctgacaaaccggaagaaaacgccggcggcgcaggaatgcctgacatgggcggcatgggcggtatgggcggaatgatgtaaaccgacaaaaaacccttgatttacaagggtttgtcggcaacggacgtcatttttaatgccctcttgatgccatttaacttttcgaggcttctcatgagttcaccgaacttgtgagaagcttctttttttctgtcttgcgggctttcgattaaattatgtaatcgattaaagcttcaaattcaaaacaaaaaacatagcatgttcatcaatgaaatattaacagccgctttttctatagcttaatattatatttgtctataattttttgcatgtactcttctacgtctggtttattttctgggtgtcgttctagatattgatcaacaattttatttaaatatttatagaaattttcgtaatctaaaattacttcttcatcttctttgactgctgggtagtcgaaataaaaagcaataccttcatctccaaagtaatcatcttcccactcttcgtagtcatcagcaaatacacaccagacattctctataccataaccttccccgttggagaatttctctaaaattcgtaaaaaacgttcatcacccatcacctgaaaaaagtagttaattaaatctttacttttattatccatttcattttcactccgaattatttaatcatttaaagttgggaaaaaatttgttatttctccagttgcttcatcaatataaccttcaaacttgagaccgtttttagcgtatccagttacttttctcccgactacttctccatttctcattgcttcttctccccactgcaacatttgttcgtttgagatcttctcgggatcataaactgtctttggagtacgaactttttttagttctccaggtttgatatttccctctctatctaatgcaggtaatccatattcaatttcatagataccatcaattgtggggtgttccctttttgaaattatacaactctttaaatcccaacctttatcaataaatgccttctcaaaactctgtagattgtgaccgccgacaatacctttatttttctttctgactatatcttctacctcaactaaatgggtatcatatccttgcctaaaagtaacatttattttggaaaaagcattatttttttcttcttcaattatactttttaacaatggtgtgtttttaacattgtgagtattctcaatatcttgtgcaattcctacaagtgcaggttcatatctgtttttaaaaaagggattaaaaaaattgttgccttttgtaattcctttatttacatgagcagcagctgttccgctctcaaccactttacctactttagaaagcttggcagtggtttgcactgcggcacctgcaccttttggaccaacgatattaccgaccgcataactgatataatgtgctcttgtgtatgcatcgccatttatcattttatcattccatgaatcgacgatgtttttccaaattattttagggtaggaggggacacttaagactgttgtaatcgtttttgtaagttttagttcaatagggagttgtgaaaattcccatgcgcccacaaccaagtccttgatgccatatatcgtatcatcaatcgcatcgttaagcccatcattaaccccatcgatgatatccaatgccgttttacctgcgttgattacactttcaccgacagccttcagctgttttgcttgttcaagctgtaccacatactgaagctgttcaggggtaagactctcatacccgaccttcttggcaatttctaagtaatcatccgggtccgtcactccgtcagccagtttcttctttaattctttgatttctcgttcttttgcttcatctttcttgatcttcagataagctttagtctgtttctcgatatctcctttcttcttatgtatgtcactttctcgataagcattggcattgtagtgaatgggtgtagcattcttgcccttgcctgtagattcctcaagcttttggaagtctttcttgatgaattgctcgattggctctgactgggcatattcagtaacaagtgcttcgtccacgcttcctaatttatcgactgtttttttacgtttgtcctctgcatctgcaagttcgtctttgaagtcttctgtcgagaacaaatcaagcggaagaatatcattgatatcaagtaggatatctttcattgctttcttctgttcagacataatggattttgacttggtgtaggcattagccagttcgtgttccaggaaggattcttctatgtatgcgccagacaagctggcgtcctctaaagcgcctgaaatgcttgttaaaaaagcaatcttcatatcaattagatcaatccaattgtcagccacaccagcgtgatcatgataaaatgctttgatgttgtcagcgccttttccggaaaactcactgtcatctaaatcagctacggctttgaaggcttttttaagattgaccatctggcttcttaattctttgtattcttttgcacgtttatctgcttctgaaagcagtgttttggcttcaaatactttcatattcatatcctttcatttaaatagatcaacaagattttaccatgggaaaatgaagaaacagacgaaatgtgatacaaaagtgtgaaatgatcaatttgatctgtgttattttacctatatgaatcactttttgggagactggcaatgtcgttagacggttccagttggatgtaaagctgacggctttgatgaatctaagaaaaagcgaaaattgaagaagcgctattaatgaaaaggatccatcttttattaggatctcagagtcgagaaaatttctataccctgtttgcttacatttggtggtgtaattcttaaaaagtacataaaagatgttgacggagtatttttgaagtgataagattcaatggcaatgaaaatcagtaattttaaagaattactttttgaagagggcgggatatgcgacttgaagagattgtgacggttaaaatagggagaaatctttctagaggacacgaaaaaaatgatccgacattagttgcttatacatatgaggatttaataaatgatttagatggctcgtttctagactcacaagttagtcttggtgctgaacagtcaaatcataaagaaagctatttgagcagtgccggggatgttgttttcagctttgtcagttccaaggctgggatcgtgagtaacttacatcacggaaaggtgataaaccaaaactttgcgaaactcatgattgaacacaatgatttggatagtcgatatttatgttatgcattaaatgagtcgcacacaatgaaaaagcaaatggcgatttccatgcaaggaagtactgtgccaaaattgactccagcgatattaaaagaattggagattgaattaccaagtattgagaaacaacggatgattggaaatgcttatttctgtttgagaaagcgtcaagctttggcgaagaaacaagcggaacttgaagagcaactttatttagaggcattgaagagattagaccaacaatagaaaaagtgaggaacacaactatggctgaattacactcaaatttatttagtgccgcagacagcttgcgaagcaaaatggatgcatcagaatataaaaactacttattaggattgatcttttacaaatacttatctgataagttattagaaaaagtcgttgaaatcgcagatgaatctttagaagaatacaacacacaagaaaaacaaacgcaattgtaccggagtttattagcggatgaagagatcaaaaatgatttgatcgagacgttagtcgatacattaggttatgatattgcgccaaagcatttattcaatgtattagccaatcaagcgaaacaaaatacgtttcagctgaatgacttgaataaagcatttatcgatttgtctacgaaatatgaccaattcaacggtctgtttgatgatgtggatttgacctcaaaaaaactgggatcagatgatcaacaacgaaacattacgataacggaagtactgaaagaattaaatgctgtcaatgtaatcagtcatgatggagatgtgattggggatgcttacgagtacttaattggccaatttgcttccgaagccggtaagaaagcgggagagttttacacgcctcaccaagtatctgacatgatggcgcgtattgccgcaatcggtcaagaagacaaaaaattgtttagcgtatttgaccccacgatgggttctggttctttaatgttgaatatccgaaactacattcattatccagacagtataaaatatcatgggcaagagctaaacacaacgacctttaacctagcgaaaatgaacttaatcttgcatggtgtgaataaagaagatatgcggttacgcaatggggatacattgaacaaagattggccgacagatgagccatatacctttgattctgttcttatgaatccgccttactctgcaaaatggtctgcagatgctacattcctagatgattcgcgtttcaatcgttacggaaagttagcgccaaaatcaaaagcagactttgcttttcttttacatgggttctaccatttgaaagattcgggaacaatggccatcgtcttaccgcatggagtattattccgtggagcggcagaaggtgtaatccgtaagaaactattggaagatggcagcattgatgccgtaatcggcatgccggcaaacttattctttggcacatcgatcccaacaacagtcatcatcttgaagaaaaatcgcagcactcgtgatgtgttatttattgatgcaagtaaagagtttataaaaggaaagaaccaaaataaactttctaaagaacatattgataggattgtcgaaacgtataagaagcgagaagacgttgagaaatatgcccacgttgcaacattcgaggaaatcaaagagaatgatttcaatttgaacatccctcgatatgtcgatacgtttgaagaagaagaacctgtggatatggctgcaattggctcgaaaatcaaagatattcgaaaagaaaaagcggaactagaagctagcttgtatgacatggtttcttcattgcaatatgatgaagaaaatgcagaatgggtcaaaggtgcgttagaggtgtttcatcgtgggaaataaacgagtgccagaagtgagatttgaaggatttagtggagaatgggaagagcgtaagttgggggatttcactgaatcttattcgggtggaacaccgagtgcaggaaataaattatattatggtggaagcattccttttatcaggtcagcagagattaattcaaaaagcactgaactgttcataacggaagatggattaaataactcatcagctaaaatggtggaaagaggtgatatcctgtatgctttgtatggtgcaactagcggagaagttggtatagcaaaaatacatggtgctattaatcaagcaatattagcaataaaacctaagttcgatgatgattcatactttattatgcaatggcttaagaaacaaaaaagtacaattattaatacctacttgcaaggcggacagggaaatttatcaggctctatagtaaaagatttaattataccattacctaccaataaagatgaacaagtgaagctaggagattttttcaaaaaaatagacgacacgatcgctcttcatcagcaagaactaaccaccctcaaacaaacaaaacagggattcttgcaaaaaatgtttccaaaagaaggggagtctgtgccggaggttcggttccctgggtttgatggagagtgggaagagcacaagttagattcaattgtggatagagtaaaatcatattctttatctcgtgatgtcgagacgactgaatatacaggatacaaatatatacattatggtgacatccatacaaaagttgccgatataatagatgagtttagcgatttgccaaatattaaagctggaaactatgaacttctgaaaaaaggagatttagtattagctgatgcttcagaagattaccaaggaatagccgcacctgcagtaattactatagatgtgccatacaaattagtttctggacttcatacgatagctttgagaccgaagcaaatagattctttgtttctttactatttgattaactcccaaacttttaggaagtatggttataaggctggaacaggaatgaaggtatttggaattagcgcaacaaaccttttaaggttcgaaagtttgttcccaacatttgaagaacaaaccaaaatcggcaacttcttcaaacaactagacgacacgatcgcccttcaccaacgcgaattagatgccttaaaagtaacgaaaaaagctttcctacaaaagatgtttgtttaacgaataaagagggggagaatcatggcaacgatccagcataaagatgaagcagaggtagagcgccgcctgattgaagtgttaggtgaagggtataatcagtggaattatcgtccagatttaaaatcggaagaagacctatgggagaacttgcgtcaaaaaatcacgcaaaacaacctatcagaaattggggaacatcccatgactgataaagaatttgacaagataaagacagagttattatcgaaaacacagactccctttgatgcagctaagtggctcaaaggggaaaatggaatagctcgaattacgattgaacgtgaagatgtctctttaggttcgatgtctctggtgctatattccaatcaagacattggcggaggaatttctacatacgaagtcgttcaccagatagcgaaacaaaaagcaaacgttgacggtcgagatcggcgatttgacgtgacacttctcattaatggattgcccattgttcaaattgagttaaaacaggccagtgcaaaagacggcgtattccaagcctatcatcaaattaagaaatacgcagaagaaggaatgtttcgaaacaatatcttttctaccctgcagttatttgtcatttccaacgaacaaacgactcgctattttgccaatgcgcttccaaaagatatgcataagaaattgatctttagctggcggacaacggataatcgaaaagtagaaaatctctatgaatttgtgaaacaagtgttaaacattccagatgcacaccgtttaattgccaattatacaattgtgagtgaagaccaagacaacaaagctctagtggtgttaaaaccgtatcaaattcatgccatagaagccttgtttacatccgccatgaggcatcaatccggctttgtttggcatgcgaccggatcaggaaaaacgttgacaagttttgtgtctaccaagttattggctcgcaaaccaggtgtagaccgtaccattatgctgattgaccgaaaagacttagataatcaaacgacgacagaattcaccaaatttgcttccgagtttaataccggtatttcttctggtgatgcaatatcgaatagcttgattgtcggaactggaagtgccaaggagttaagtgatactctactgtctgatgccaattccaatacagttattattaccactcgtcaaaaactagaagctgccttgcgctatgcccaaaggcaagaggagcaaaaaggcactcagcgctttaagaaactgctggggcagcatattgtctttgtcgtggatgaatgccatcgtgcgttaagtgcagaaggcatggaggtcattaaggggttctttccaaattcaacttggttcggatttacagggacaccgatatttaatgaaaataaaaaacaagcgaagggccgattagctcgcactactcgtgaccaatatggagacgttttgcacacctataccattaagaatgcgttagacgatggtgctgttttagggtttcaagtagagcatgaagatacaattgaccccacttcattaaataatcatattttcgaactgctgcgtcatcaagaaaaatacgccaattgtagtgatgatgaaatcaacgatatgattgatcaaatggatggaatcgaaaaagaagcatatcttgaaccatcttcgttccagaatgatgaacatattcaaaaagttattcataagatttttaggccggataatgcctatattaaatttgattttcaaaacggccgcccgcaaaaatcagctattttaacaacgagttccattgatatggcgaaacgttactatcaggcaattaaagaaatgacgaaagatccagattggttaacaaaagagtttgcgggacacccgatccgaatagggcgtacaattgaagatcctgattttcctcggattgcaattacgtattcaatgcaagaaaacgaggaagattccaagcaaactcacgatgaaatgatggagatcatcaaagattataacgattactatcatactgcctggtcgatagaagatattgaacggtataacggcgatattaacaatcggttagctcgtaaaaaaggggaattcaaagaaattgggaaacaaattgaccttgtcattgttgtcgatcgattattgactggttttgatgccccaacgattcaaacgttatttgtggatcggaatttaagttatgccaatttgattcaagcattttctaggaccaatcgtacttatccaggaaagacaaaaggattgattgtgacattccgtaaaccttttacaatggaacaaaacgtaaagaatgcgacgaagttatattctcatgcacaagaggaatctagtcttgtttatccaacgtatgatgaatcgaagaaacgttttaagaaggcccacaaagtcctaactacgttaattcccaatccaatcgatattgatgagcacacatctcttgaaacccgaattgagttcgtaaaagcatttcaagagctaaacaattcttacgaagcgttagttacatatgatgactacaacgatgatatggagaaatcagcagcacttcaagaacaggtgaaaacactagaagaatatattggtatctataacacgattaaaggttcacttatagatgaagagcgtcaagatggaccggagctggacttttcggacattgaattctatggagaaaacgcagtgaagatctatgatattgattcaacgtatattgatcgactattagaaacatactcggccaataaccagaatatccgtgatgagatcgaaagcgcacttcaaaaactggagaaatcagacactgttaaagatgtataccgtgagatgttaaatgccattgatacgaaaaacgtagatgaagaggaagatattcttgtcgtgaaacgaagctttttcacgaaagcacgagacaaagcaattcatgaatttgcaaatacttggtttgtggaagaagatgaactgcatttatctgcagttcaatatgtgataggggcagatcctattccgaatatcgggggaatcatcaatagcaagcaatttgatcggtacaaagccgtacatccagatgcaaaaccattgaaatacggaccagagttgaagcgtcagtggagaaaaacgttagatgaagtcattgtacctttggatggcgagctgagataaagtctatataggccaactactgcgaatcttgagttggcctattctatttattatgaagaaatatcatgagattgctgacagaacgactatgcgtactagtcgttttctttaatcatcttttccagctgttccacctcaccccgaatcccaatcccaggctcccacgaatcaatcagacgaatggctttctgattcgattccatcgctttcgttttctctccttttcggtacaacagctgtgccattccgtaataatagtagatcagttcaacctgattggcgttgtgtttgtcatagagcatttgttcaaaggctttttccgctttttcgagctgatcacacttgacgtaagccatgcccaggttgaaataggcttctatcgttttttcgccgccgtatgcggcgctggttgtgtttgccgcttcgtataatgtgatggcttcttcgtagtgagagcgggcgaaactcaggtcgccgcggaccagaagaaccctgtgccggataatgggggagacgggctgatctttgatgccatccagcattgctgccgctttgtccggttctccggtttttaacagcagcctcgattgcagggcggttccccatactttcaagtcgtcgtgatccggcgcgcctgattgttcgagtatcttcaggccggcttctatttgcctgagggctccgtctgaatcattgacttccatcagcgcccagcctgccgtgtcgatccgaaagtaagcttcccgcgtgtgttcgcctgattgatgggcggcatcggcggcttttaatccgtattcgattcgcaggggcaggttgattctgcttagaaaatggctgatgcggatgatgagtttgatcaggatgtcatgttgtcctgtttcgctcgaccattcgatgacctttaggatgttcggccattcttttttcatttgctctaaattccgtcccagcaggtagctccaatagacggaattcggccgttcccgttttatatgggtttccgcataatcaatataataatgcgcccagcggctgcgggcttcttttgcaaattcgtgattttcggataagtgctgttctccgtaagcgacaacggtttgatgggctgcgtattgaattcttccttcgcttcgttccggctgtattaaagcatatgacctcatttgctcaatcgcgtaatgaaaccgccggacgtctaatccggccgctagagccaagcttttctcatcagggggcttagcgaaaaagcaaagcgtctgccatagttttcgtgtgtcttcatgacatctgtcccatgtgcggccaaagagaacctcaaacaattccaataatgagtagcctgcttgtttaagttcttgaatgagctggggagcggggatgtcgtcgtctgacatgtatgcaatgctcagtgccatggccttcgggttgccggcggctgccgagatgaattcattcttaaggtcaggcgatagccgcagcagctgctccagcttttcccgtttttgcgggaggttgcatgtttgcagacatcggtgcacttcttgctgaaaaaattcaagggcatccgtttgttcaaggccgctcagctggatggccgccagttccccgaggccgtcccggtaagtctgttttacgttttcccgtgccgtaaggaggacttttacgccttgcggaaggccgatgataaattcgtgaatgtcacgttccgctgtatcaatgctgtcaacgatcagcagcacgggtttttcatttgaatgagcggctaatgcattgcggacgacgaaccgtttttcgttgatggatttgtcgatttgttctgcgcgtccgagctgataggcgatcgtgtttaaaaaatcgctgaagctcaatcctttccagtccgcgctgatccagatgatgctgttgaatgccggccaatctggtgaaccgccggcacaaaggtaggctgcttcaagagcgatcgttgtttttcccatgccggcccagccagtgattaaacagaccggtgacggagacagcatccattgccgaatcgcctctatatcaaagccgcgtccgataaagttcccggtccggcgtgacggtaagttatgcgtgacggactgttctgtaagcgcattcgtttcatggcttggtctgtcatgaaacagccgctttactgctttttcaacatcttcatcactcggcgctccgaatgatccgtctttccggcgtatttttgctttttttagacaagacgccgtccaaacgggcaatgcgggtttgatgacaggaatggtggtggtttccagaaggccggtcagccattcaggatccatgtcggtcttttcgataatgatccaaatcaagccgaacagctttccgtcgtcaattcgtccgggaatgtagtttgcgcccatctgtccgatccagcttttgatcgtgttagaggaaacgcctaatcggagtgcgatttgatctatataagactgtcctgttttttcgttctttttccttctgactttataatcaggatgatgtttcagcgatttgacggcaggtgccagcagttctgcaaattgtgtccggttttctagttcagccattagcctgcacctcctattagtactattttatcaattcagtgttttttgtatatgaaaaattaaaaagtacagtgcggctgtccttttatacagcaggaaaggctgttgaacgtatggaaaagcagataaaataggggcagtaatagagaaaacaaaaatgtatgcacttacatttcaaagcagagaaaggattttgccaaatgactcacacagtgcctcaaaacatgaaagcggcggttatgcacaacacgagagaaatcaaaatcgaaacattgcccgtgcctgacatcaatcatgatgaagtgttgattaaggtgatggctgtcggaatttgcggatctgatctgcattactatacaaatggcagaataggcaattatgtagtggaaaaaccatttatcctcggtcatgaatgcgcgggagaaattgccgccgtcggatcggctgtcggtcaattcaaggtgggagaccgtgtcgccgtcgaacccggtgtcacatgcggacgctgtgaggcgtgcaaagaagggcgttataatctttgcccggatgtacagtttttggcgacaccgccggttgacggcgcgtttgtccaatatatcaaaatgcgtcaggactttgttttttcgcttccggattcactttcctatgaagatgcggctttgatcgaaccgttttctgtcggcattcatgcggccgcgagaacgaagcttcagcccggttcaacggttgcgatcatgggcatgggtcctgtggggctgatggccgttgcggcagcgaaagcatacggggcaggcacaattattgtgaccgacttggagccgctgcggttagatgccgcgaaaaaaatgggcgcgacgcatgtcatcaatgtccgggaacaggatgccggtgaagaaatcaaaacgatcacgaatggcagaggcgttgatgctgcctgggaaacagcggggaatccggcggcattgcaatccgcactggcttccgtgcgccggggcggaaaactggcgattgtcggtttgccttctcagaacgagattccgctcaatgtgccgtttattgcagataacgagattgatatatacggaatcttccgttatgcgaatacgtatccgaagggaattgaatttctcgcttccggtatagtggacacgaagcatcttgtaacggaccaatatccgctggagaagacgcaagaggcgatggaacgcgcctttcaatacaaaaatgaatgcttaaaagtgatggtgtatccaaatcgctgagtgaacggggaggatctttgcattctccctcttgcttatcaaaaatgaaaacggattcttggggtgggaaatgatgattgaaacagaaaaagcagcggcagtaaagacgaaacatcgcggcctgtcctggatggaacggatcggctacggattcggcgatatgtcgtacaatattatctttcagtttgtaaacgcatacttattattctactatacagatgtcggcggcattaagcctgcggtcatcgcagctttgtttcttatcgtaagggtgctggacgctatttttgacccgattatgggcgtgattctagacaagacgaatacaagatggggaaaggcaaggccgtatcttttgtgggtggcgtttccttttgcgttatttacgttcttatgcttcacgacccctcatttcggcgagacggggaacatggtttatgcgtacatcacttatattctgcttgggatgtccttcagcatgcagacgattccggtcaacagcttaacgggtcggatgacgaattccgtggaggaacggacggttctgacgacgacccggatgattttggtttatatcggaattctgttgtcgatttcctgtgcgacaccgcttgcggacgccatcggcgggaaagatcaggcgtttggatttcagatgacggcgcttatctatgcggcggtgagcatcgcattgaatctgttcagcttctttaccgtgcgggaacggattcagcctgaaaaaagaaaaaaacaaggaatgaaaaaaacgttgtctgttttgttccgaaacaagcctttgctcattttggtttctgcatttttggcgtttgcgattgggtttaacattaagctcagcacgatggtgtactattttacgtataacgtcagccataaggaatttgtgtttttaggaaccgtgttgtttttcggcgccgcgctgatcagcaatctgtttattcctttcttttctgagaagcggggccggaagcaggtcatgatcatcacggcggcgttatcgctgatttcttatgcgggccttcagtttacatcgtattcctcgattccccttattttcttttggcttttcgtttcgggattttttacgacgcctttaaatacgcttgcttggggaatggttgccgattgtgtcgattatgcggaatggaaaaccggagtccgggctgatggcgtggtgatttcgagcatgagtttcatcaataagctcggagttgcgttagccgggtcattttcggccgtttatctcggaatcgccgggtatgccgcgaataccgaacaggccgcctcgtcattgaatgcgattaaaaatatgaatgcgctcattccgggattgttcattctgctgtctattattcttatttctttttatcctttaactgaaaagaaatatcagcagatgatgtctgatctggagcaaagggctgcaagatgagtatacgtaaaatttaaaatattctatgtaaacggttgtatttatgactgaaagcactatactgaaactataatcgagaattgataaatgagtgtgataatgtgggaagccaatctgttatttgtattggagaattgttaattgatttcttttgtaccgatgtggatgttgatttgacggaagggcgcaatttcttaaaaagtgccggcggcgcaccggcgaatgtgtcggcagccattgctaagctgggcggagacgcggctttcagcgggaaaacaggcaaagatccgttcgggtattttctgaagcagacattagacgccgtacacgtcgatacctctatgctcgtcatggatgagaaagcgcctacaacgcttgcgtttgtttcattaaaacaaaatggggagcgcgactttgtgtttaacagaggagcggacgctttgtttacgctggatgatattgatctggaaaaggtaaacgatgcgaaaatccttcatttcggatcagcgacggcattgttatctgatccgttttgctcagcctatttacggctgatgtcgattgcgaaagacaatggacagtttatttccttcgatcctaactaccgtgaggatttatggaaaggaagagtttcagagtttataaacaccgcaaaaaaagccatcgccgtaagtgattttgtgaaagtcagtgacgaagagcttgagatcatcagcggtgcgaaggatcataaagaaggcgttgcggttcttcatgagctcggggccggtattgtggcggtgacactcgggaaaagcggcacccttctttcaaatgggaaggatattgacgtcattccgagcattccggtgacatcaatagactcaacgggagcgggagatgcgtttgtcggcgcggcgctgtatcagctggcgcgcacggatgaggttcagacggcagccgaagattttgcgaagctgcgtgatattgtctcatttgccaataaggtgggggcgctcgtgtgcaccaaaatcggtgcgattgatgctttgccgagcttaaaagaggttgaagtatcactgtaaagtatggaggatgtttcttgaaagtcatcggacttcgggaagcatcctctttatttaggtctgaaacccttttcgatatacggtatactttagaaaggcatccagtaaattgaaccgctgtgaagtacatacaataatgtttttatccgttctgagtaaaaccaagtttctgctgctgccgtcatgtacagtgtgacggcctgtgatattgaaccgcggaggaatgtttttttatgaaacatgtttttcttattgtgcaatgcgcgttttctgttttttgttttctttgtctcgccgctgtcaattggtatcaggggagtgagcttgtttctgattcgtttgattggaatgatacggctaaattctcaaagcttttgaatgggacggatacgattacaagtccggaacagatttcgcagttggatttctttgtgtatgctgcgaagcattatccgttagtgagcgggttgatgatcgggctgtttgtttattttttgttctcactgtatctgcttgtgaggaatttccgtcggcacaaatgggctgaatgagactattttcatataaaaatacataaattcaagaggaaatgaaacctttttcgaaaaaaacagtatatataactgtgaacttgttactattaaattttgggaggaaaatgaaaaatgagtattttaggaagatttaaagacattatgtcaagcaatatcaatgcgctgctggataaagctgaaaaccctgaaaaaatggttgatcaatatttacggaatctgaacagtgatttaggaaaagtgaaagcggagacagcttctgtcatggctgaggaacagcgggcgaaaagagcattaacggaatgccaggctgatgccgaaaagatggaaagttatgcgatgaaagcgttgcaggccggcaatgaagccgatgcgcggacatttttggaaaggaaaacggctgttgaatcaagactgactgaactgcaaacggcttatcagctcgcttcttccaacgcgtctcaaatgcgcaaaatgcatgacaagcttgtcgctgatatcggagagcttgagtcgcgaagaaatgccatcaaagcgaagtggtctgtggcaaaaacgcaggagagaatgaacaaattggggtcctctgtgtcaaatgcgggccaatcgctgacagctttcggcagaatggaagacaaggtcaaccgggcgcttgatcacgccaatgcgatggctgagctgaacgcgtctccgaaagacgatattgacgagctgacggctaaatatgacagcaatcaaagcagtgtcgacgatgagttggcggcgcttaagcagaaaatgcttttcagtaaagatcaatagacagcgggctgcagttttgtccgatataaagagaaagtgagagaaacagaatgatcatttcttataaatgcccgaactgcggcgatgatatggtctttgacagttcatccggcatgctgacatgtcacagctgcgggcggcaggatcagattgagagcctgccaaaagagtatataacgacgagattttccgaaaatgaggcgaacgagtaccgttgtgagaactgcggcgcagtattaatgactgaggcggaaacgacggccacgacgtgcgggttttgcggaggagccgctgttctcgccgaccgattatcgggaaatctcgcgccttcgatggtgatcccttttacgatcagtaaagaagaggccatgagcgcttttaaaaagtggtgccgaaacggccgtctgacaccgaaaggatttatgactgccgatcgggtgaagagcataaccggcatgtacgtgccgttttggatgtttgacttaaacagcaaggttcaggtcaatgccgtttgtacgagagtgcgtcactatgaagatggagaataccgggtgacggagaccgagtattacaacgcgtaccgcgatatcaatcttgattatctcaaaattccggtcgacgcttcagaaaaaatgaatgatgaattaatggacaaattggagccttactcatacagtgagctgaaggagtttaatacggcctatttagcgggatatatagcggaaaagtacaattataccgatgacgatctttttccgcgggcgaaggataaaatcagccattatattgattcttatatcagatccaccttctccgggtatacgacggctgacattacggatgagcagattcagaccgataaaatcagcagcttttacgtactgcttccggtctggatggtcagctacgactatgagcgggctgagcacatttttgcgatgaacgggcagacgggcaaggttgtcggcaaaccgccgatcagtgccggaaaagtggccgcgtggttcggcggcataaccgccggtgcgtttttagcattaagactcgtctcacttatgataggaggcggtttttaatgaaagtaccgatgaaaaaagcgtgtctcttctgcttcgtcctttttctgatgctgtctttttctttacatacatcggcgtctgccgcggaacagaagcaatatgtttatgacaatgctcatttattaacgaaggatgaaacgaagaaacttgaggaattggccgggaagctgggagaaaagcgccataccgattttatcattcttaccgcaaacggaacgggcggtaaggagatcgaacagtatgccggtgatttttatgacagtcattttagcggaagcacggccatattgacaattgatatgaaggatcgggaagtatttctctccggatataaaaaggcggagacgtatttgaacagcagccggctgaatacgatcagaaatacgatctcgtcagatatttccgcaggccattatgaaaaggcgtttcagacctacatcaagatggcttataaagatatggggaaaagtccggacgacaagtctgacaatctgctgctcacatggtggtttcagctgattatcgctgcagccgcggccggaatcgccgtcaccgtgatggtgtacaattccggcggcaaggtcaccgtcaccggcagcacgtatatggatcacgatacgtctgaagtgctgagccagcatgacacatatatccggaccgacattacaagagaaaaaaagccagataaagataatgacaatgacggcggagtcacgaggggcggcacgagttacagcggaagcaagggaagtttttaatttatatgtaaaggatttgagcatacatgggttttttcagaaatcagttagcaaatgtggtggaatgggaagaattcagagacgacatggttttctataaatggaacaaccgtgaaattaaaaaaggcagccgtctgatcatccggccgggacaggatgccatctttttatacaacgggaagattgaagggattttccgtgatgacggcgattatgatatcgaatcagaaatcattccgtttctatcgacactaaaagggtttaagtttggctttaacagcggcatgcgggcggaagtgctgtttgtgaatacgaaggagttcaccgtgaagtggggcacaaaaaacgccatcaacattccggcggcaggtatgccgggcggtatgccgatccgcgcaaacggcacatttaacttcaaggtcattgactacatcggattgattgataagattgcgggtgtcaaagacagctatttagtagaggacattaaaatccggattacgtctattctcgatcagcttttgatgaaatggatcaccagagaaggaaaagacatgttcaatctgcagtcgaattcatttgaaatcggaaaagggattcaagaagatcttgatatgcagctgatcggagacggcatgtcgattacgggcttcaatattatgagctttaactatccgcaggaagttcaggatatgattacgaaaaacgcttcttacggcatggtgggcgatgtgaaccgctatcagcagatttccatgacggacggcatgtcatccggcaaaatgagcggaagcggcgccgcctcagacatggcgggcatgatgatgggaatgaatgtggcaaatcaaatgatgaaccaaatgaatcaaaatcagcagaatcagccgcagcaagatcaaagtcagcaggatcaggggacggcgccggcaaacagctcggaaggagcggctaagccgaaattctgtccgaactgcggaacgaaaacggaaggcgcgaatttttgcccgaattgcggacagaaacttgcctgatgatatacgaaaaagaggcctttttggggcctcttttttttgtcatgatttcattgtttgaacgatgagggatgtcagtgcttttgatccctcaggtatgagatggacgccgtccggtgtgaagtattcagggtgctgcaatgcttttgcgtgccaatcgacaagcgtcacatttttgcgtgactcggcctgccggcgcaatgattcgtttactttgctttcccactgccgcggtacacgcgtgttgacaagatagatatcggcttttgaaaaggagctgatcagtgattcaatttggctgtttgtgaaatagccattcgtccctaactcgatgatgaccgctttgttcggctgattaaatgacgcatattccgaagtgagctggagtgcttgagagacttgtcttcctacctttccgtcgatggtgacatgagggagggactgccgcaggtatgacgcaatgtccagcatcaccgagtcaccgatggccagcacgtcttgctgaggctgtgcttgttttgaatcagccgttttttgagatgaccgttcctttttctcgtcggttttcttcgtttctgatttgtctgctggttctttcttgtttttgtctgacgcggtatccgttttttcgccgccgtgttttttcttgctgtcttcttcttttgcaggctgatcgtgatcggccgttttgtgcgaagaggcggcggtttcttgctgatcattctgcgcgtacgtccattgcggctgttttttctcttcggctatccctgacagcccgcccgcaaatacgagaatggcggcaagaatgaggccgagcaacattctgctgatgacagaggacgtcttccattccagaaagcggttcagaaacacgcggcgtaaaaatggccggaagcccgcagtgcggatcggctgttcaatgaaatggtaagatagctcggcaagaatgaaagtggcgccgattctgacggcgcagtgccaataaaccggatttccgatttcctgcacgggtgtgctcagtacgaaaaccgggtaatgccaaaggtagattccgtatgatctcgttccgatccagcgaagcggcttccatgaaagaacatgtcccaaaaagctgctcggatggcataaacatgcgacaagaaccgctgcggtgatgctgattaaaagcatgccgcccttgtacaggaagggttcatattcatccgtgtaaaagacgcaaagcagcagcgcggcaaaagcggcaagctccgtcccgtgaagcaggtgtttcatgctgctcggcagccgtttggaagataatcgtttcatcggccacactaaagctaaagcgcagccgatcagcaattcaaatgaccgggtatccgtcccgtaatagacgcggctcggatctccgccgggcacatacatcatactcattacgactgccgaacataacgcgataaacatgaccgcggccgcaagccgggcccgtgttttacatatgtacattcccgcaagcagcaggaagggccatatgatataaaactgttcttcaatcgccagcgaccaaaggttttttaatggcgaaggggagccgaagctgtcgaaataagaaagttgatgaaagataaaccaccaattgcttatgtaaaaaagtgaggagaccgcatctccgcgtacggtatgcaggagctcgctgttaaacaatacgacccaaatgaccgtcgcgataatcatgagataagccgccggcagaagccgtctgatccggcgcacccaaaaatcacgcaaatcaagggtgatgtcattgccctgggcaggcaatataatagatgtaattaaataccccgataaaacaaaaaagatatcaacaccaatgaaaccgccgtcggcccagttaaaattcagatgatatgcgataactgcgaggacggcaaaggcgcgaagtccatccagtccgggaatatagcggtgatgcagtgacttgtctgacatggtattcctccaataatgtgtgcggaaattctcgctgttttgcggatagctatagctgatttctgtacagtcttccatttgttccgttaattagacgcattcggaaggggattttgtttcagaaaaaatgtatgaaatgctgtgattttcttaaacttttcagcctccgtccggcgtctgttatatgaaaagggtcccttatgcatcttggctgttgcgggacgaaagaaaaaatccatgatctgcggatatcatggatttttttctttctttatctgatgtagcggtctccgacaagcagcttggagatgacggaggtcggtattgtaaactctgtaacgcccatatatccgggtgccgcttcgtattcatcaaatgaaataacaagtttgtgcttatctgtaatataaaaattctggtcggcgcggatggctttaaaaggctccgtcatatcatcttcttcgacccagtatattttattcggatcttctttcatctgttttttcatttgttctttaatattttcgctgatgactttaatataacggtcatctttaaataagctctttaacgtaagcacggcctcattctttttatcaatcgtgatgtatctgctttgcgtataagcggaagcttgtgttttttcgatatcacggcggattgagatcagatccgctgtgtcagtaacggtttcataatcgctgtaaatactgaggtggccttttttgctttttgaggtcgccttcataaattcctgatacagctctttgctttctttcatataatgccggttgatgctgtcttcgagtttatgatcggaaagtccggacagagcgggcgttttcacatcaatgcttgattggttcttttcttccttcatctccacgaatgtgatggcttggacgactttgccgatgacggggattttagacatggcttgtgcggcatccgggttgatattgacaacggcggtaaataagacggccgcagcgactgccgcggatgtcggccacatcacgattcgttttttcttcggtttttgctgaagggctttttcgacaatgctgtccagttccttaggaatgggcacacttttatactcttctcttaattgttctaatctcttttccattaagaaagatcctccttcgtcagctgaatgcgcatgagcttcagccccctgtaaaggcgtgttttgacggtgttgatgttttcccccgtgatgtccgcgatttcttctaatttcaggtcttcaaagaaacgcagaatgataatggttttatattgatgcggcaggtcatcaagcgcttcgtgaaggtctgtgtctttgtagtgatcttcctttccgcggcttaaaaactcgatcgtttcatcgtccatcactttcagttttttctgtttgcggagaaaatcaatggccgtgcgcactaaaattttataaaaccagcttttgatcacatcggggtttttgacggattcgaccgatgtcagcgctttttgaattgattcctgaacaatatctaacgcgtcatccttgttctttacgtaactgtacgcaagccggtaaaagtcttccttgcgctcagttatgcacgtcacaagcgacgctttggctgtttcgttcttcattgcttcaaagggctcctttttaaaaaatacgtatcataggctgctgcctaaggatagacgggacagggtgaaaaatagtttgcgcagagggggtcatttttaaaaggaaaaggaaggaaagacgatgagatgaaaaaaagagccggaacggctcttttttggatgtgtctgatattcagctgaacggtttagttcggtttgactaagatttttacttggtttttctctttgattaaagcgccgaagccttcttcaatgagatcgtcgagcacgatttttttcgtgacgagcttatctgctgagaagtagccctctttcatcagtgcaagaacggaagggaagatgtcacggtatccgataatcccttttacggtccgttctttgatgacgatatcgttcggatgaatttccgctcctttttcccagatgctgacgataaccgtttcaccggcaatgtttgttgactggatcgcctggcggagaacgacaggaacgcctgttacttcataagaaacatcaacgccgccgtttgtgcgtttagcgatttcttcaacgacatcgtccgtttttgacggatcaatgatgatagcgccgagttctttcgctttttcctgacgttccggtgaaagttcaaccgcgtaaatatctgtggcgccggccgctttcagggcttcaatcacaagcagcccgatcggtccgcagccaaaaactgccgccttgtcgcccgcttttaatttgctttggcggacggcgtaaagcgctaccgctgacggctcaacaagcgcgccctgttcgtaagaaagctcttcaggaagcttaaacagcaattcttcgtcaaccgatacatattcagaaaatccgccgccgcctccggctaagcctaagaatcccatttgttcatcaaggttataggctccctgatgtccgtgtgtggcaaaaatcggttccacgacgacacggtcgccgacgctgtaatttttgacgccttcgcccacttccacgacttctcctgagaattcgtgacccatcgtgacgggcgccatttcgtttgttaacggatgaggttcgccgaccggaataaagatcgggcctcccaaatattcatgaaggtcgcttccgcaaatcccgcaccatttgactttaattttgactttacccggttctgctttaggttcatcaatgttttcgattcgaatgtctttttgattgtgccatcttgccgctttcattgattatcactcctagtctgattgaaacgagtataggtacatgatcaatatgaaccacggttaaaaggaataaagtgcttcctaaagcctgatttctcaaaatatatcatattatgcaactatcaataggccttataaaaagtccatattgaatgcagaaatactctatgaatattataacgctaatgaattaaattttgtagtataatttaccatggaattatatagaacaggtaattgtgccgtcgttatgtgcatgtctcatcacgttgtaatgaacatgtaaagtgattgaaatattataatcgtcttcttggtgtataattttgcctagaataaagaatcaggaggacgaaagcttgaagaagttattcttagccttattgattttagcaggaagcacgctgggagcgatcagttactcttctgatgcaagtgctaaaaaagtgaacggaaatattacatggtataatggagtcggtaaaaaaggatcttccggtaaaaaactgggacactgggattgcgcgacaaaattaggatttgacgttccgagaaacggaacgaaaatcagagcttatgcgaaagcaaaaccgaaaaaggttatcacagtatacaaaaatgatgtaggccgtctgccgaatgccgtgttggatgtcagcccgaaagcgttcaaagcgctcggatatccattaagcaaaggaagagtatccggacactacagctattaaaatagaccatcttaaaaagcaaggactctgattcttgctttttctgattgacggagagattgataatgaagaagaaacgatggatctggattttgctggccgccgttttggcggcggcggtcatcgcgtccgttttactgattaaaggaaaaagcgacggcggcggaaaagctgttgtctccggcggccatgacaagctgctagtttccattacagacaaagatctgatgacgaaatattacgaggacggccgcgtgctgtacgaggaaaagctttcggcatatccggcgtttgcactcgatgacgcccatcaggtgctctattttgtcgggaataatgaccaaaatgagatgcgtctgtataagcttgatctgaagacgaaaaagaagacggtgctttataaaggaacggcaagcgctgacagtctgtttttatcaaaggatctgacgcacatttatttccgtctcggaaaagcggatgaagatattttccgtctcgcatcttttgatttgaaaacgaaacgttatgaaaatctgtatcctgccgctgatgagaaagacgacagtgtaagcagcttcttttataaccgcagccaaaacgattttgcgcttctgcattattccgtcaaagaggattatcaaaaaacggatgaggcaaatgagaaggggattgaccctgaaccgacgaatatccggtttgcagcaggagcgggcgaacaccttcaggacctgacaaaccttgaacagtttatcagcggcgtggcggtgtcaccggacggtaagaaccttgtctttacatcttatacacaaaaagggacggaacaaaaagcgtccatccgtctgatgaatgtcaaaacgaaaaaagatgaaacgattatctcaaacgggaaggacttcgctccgctgattgatgcccagcctcagttttctaaagacggcagcatcatttatttcatggcggaagcaaaaggcgctaagcgtctgaaggatgaaacggggcggaatgcgaaggtccggaccatttatgcttatcatttggatacgaaaaaatgcgaaaaagtctgggaaaatgacaacggcattatcaatagtttttccgtcatccaatcatgaaaaaaacactcagcgcccgctgggtgttttttaatgaacaaagctggctgcggctgaggcgagccgtttgaaaaaacggagaatcggaacggcaaaatgaagcgtttcgatgaatgactgtgcggcaaggttcattttccgccgttttgccatttccttcagatctttctgctgccgatcgtttttcatgttcattgctcctttgcatcgtaaaaggacatgataacgcaaaggcctctcatgagacatggaggccttctctatgttgagactcgtaaaagggaggtctaacttgatgccgtttgattattgttttggagatttaccaacgaacggacgccgtcgatcattttactgccgcaaagggggcaagtcggggtatcactgccggcaaaattctttctgctccagccgatacagtcctcttttgtgcattcccacgtactgacatcttctttaggcagcggttcctgattacgtttgttgtagtaagacataaagtcacttcttcccttatgaattttcgtgcactccttcattgtctcatacttttccctaatctcctaattcctttttctatccagatttccaatgagggtgcatcgtcttcctgttattacagtatatgcaaataagcgccttcttattttttctttttggataaataaaaaaagccccttctggagaaagggggggatgtttgtttactgcttatccgtgacgtccatcggtctcatcatgtcgtaatcttcgtgctctaaaatatgacagtgccatacgtagcgtccgctgtatggagcgaaagtcgccgcgattctgatgacttcccccgagtgcgcctgcacggtgtctttccagcctttttcacttggaggaggcgggacggcggggcctgtatacacaatgtcgccgaatttgttataacgctctaagtcaaagggacgccggtcaaggatttggaaggaaacaaggtgcaggtgtatcggatgggttccccccatcggattgataatcgaccagatttccgttgtgccaagcttcggcgcttctgtcacaggatcatgccatcgcttgttattcagcgtcaaaacgggccggccgtatttgtcttgcgtatttgtgagtttaagcgtcctgatattgtgtattctctttgatgtcacattaggcattgttgaaagatatttaggcttccggcttgtgtcttctcccttcagcggttttgtgacgcggaattgcatcacattggcgtctgtatccggatcgacgtcgcccccgcagccggtgccgttcgttaaaatgatatgttctccgtcaaaggaggagaaatcgatgagcacatcataccgctctgccggggctaagctgatagattgtgttttgaccgagcggggaagcagtccgccgtcagaaccgatttggataaacttcccgccgttattgagcgagagagaaaatgttctcgtattggaagcattaaggatgcggaaacgatatgtccgcggttcaacttccatatacggccacgctttaccattgacgagaatggtatttccgcaaaaaaacgggacgatggaagggtcgggcagcgtttcggaagggttagcaggtccgctcggataagacaaggaaccgtcgtcatttaacgtgcggtccaaaatcataagcggtacgtcgtactctccggagggaagcttcagctgcttttcttttcgctcgcggatgatatacatcccggcaagcccggcgtacacattgagcctcgtaatcgccatggcgtgatcgtgataccataacagagccccgcgctgtttgtttggataatggtatacctctttctcaaaataaggacccgtttccttaaagtccttcgtgaaccatgcttccgggtagccgtcgctgtccggcggcgttgctcctccgtgtaaatggacgacggttttgacatcggggtcctgatggccgctttctgaatggtgaatggtatgatccacgggcagaaaatgcttatccggcaggtcattcatccatttaatatagacgttttcatctttgttcacgtcgatcgtcgggccgggaaacaaaccgttatacccccaaagccgggtcggcgggagatcgcggtgcagcttgtgaaagcattccttcatggtgacttcataatacgtgctgccgtctgatttcttctgcggctggagtgtttcgataatcggcagttcatctgcaaatttttctagtgccatttttcatcctgtccttatcatttattgaaatcctgtactacagttaatgctgcctagaacaggttggttaaaaaaacacccgcccttttttgagggggggtgtttgcggttattgcgcaacccggctttcggaagcgctctctttcggtttttgttttttgcggaatacatatgaggcaagtaccagcagagtaataaatcctgtcagcagaaattcagaccgcattgaactgataaacagcatagataacaagatggcgcaaatggcgatgatcgtcaggtaggttaagtacggataaaaccacattttgattttaagagattcagggtttgtccgttcgattttctttctcattctcagatgtgagacggcgatgacgagatagacgagcagtgcgatcgcccctgatgaattgaccaggaacaaaaatacggagtcgggagaaaagtagttcataacaacggcaatgtaggagaaaaaggtgccggcgataatggcttgaaccggtacgcctcttttactcagtttcataaaacgccgcggcgcttcatttcgctctgccagtgaatacagcatccgtgacgtcgtataaagcccggagttcaggcaggacagaacggctgtcaggacgatgaaattcatgatttgagcggctgcgggaaccccgatatggctcaaaacggcaacgaaggggctttccaaaatattggctgaattccacggcagcagtgtgaccacaaccgcaatggagccgacgtaaaaaataatgatccgccaaacgactgagcgggtcgcctttgtgacggattcgaccggatttgacgtttctcccgctgcgattgcgacgatttcagatcccatgaaagaaaaaatgacaacgacgatgccgagcagaacggaacttggacctttagggaaaaatccgccgctgcccgccagattttccagcccgaccggcttgctgccggggacgattccgaaaatgaaagcaaatcccgcgattaagaagacaacgatcgtcgctaccttcactaaggaaagccagtattcaaattcgccgaatgatttaactgaataaatattcgtcagtgttaacagcacggtcagaagcagactcgtcagccataacggaatcccggggaaccagtactgtatgattccggcgcccgcaatggcttcaatggcaatgacgatgacccagaaaaaccaatacagccatccgatggtataaccggcccacggcccgatggcgtcatgcgcgtactgtgaaaacgaaccgcttgtcgggttgacggaggacatttcccccagcattctcataataaaaatcactaataatcctgctaaagcgtaggagacaatcgctccgggtccggtggaatgaatgacggatccgcttccgacaaataatccggcgccgatcacgccggcaattgaaatcatggtcatatgccgggtttttaatcccttagataaagagttaggctgattcattctttgcctccttttggtttgtttatgctgaatattccgacaagtattattctatcataaatgctatagacagttgaaaatgatgtaagaaaatatgacatttttttcgcattcgtacagcagaaggcgccgggatgaaagaggaacatgccattgaccattcacacgttcatatggagcctctccagctgaaataaagcttcctttctaaagggagcttttttcctttttcggactggaaacaattcgctggaaacgtttttttatactgtttatattttgtggtaaagttaggttacgataattgaaatttgagagatgactaggaggagaagaatggcttataaagaagagctgcatccgatgctggagaaagccgttgagcatattgaaaacatcatcataggaaaacgggatatcgccatactcagtctggccgccattctcgcaaaagggcatgtgctgctggaagacgtgccgggagtcggaaaaacgatgatggtccgggctttggccaagctgatcggagctgactttaagaggattcagttcacgccggatcttctgccgtcagatgtgacgggtgtctctatttataatacgaaaacaatggaatttgaataccgcccggggccgatcatggggaatatcgtgctggctgatgaaattaacagaacctctccgaaaactcagtcttccctgcttgaggcgatggaggaagggaatgtcacgattgacggaaagacaatgcggctggctgagccgtttttcgtcatggccacacaaaacccggttgaatatgaaggaacgtatccgcttcccgaagcccagcttgaccggtttttatttaagctgcgcatgggctacccgactgccgaggaggagcttcgggttctgtctttgcaggaagggcgcaatccgcttgaaacaatcgagcccgtcatttctaaagaacagtttatcagccttcagcaaaaactggagcaggtgcgggtggatgatggaattaaagcgtacatcgtcggcatcattcagcatacccgtcggcatccgtccgtacatctgggcgtcagcccgcgcggttcaatttcattaatgaaagccgcacaggcgtacgcgctgcttcatgaccgcgattacgtcattcctgatgacgtccagtatttagctccgtatacgctgccgcacagaatgatcttgaccgccgaggcgaaatttaacgatgtgacggcggaagcggttatagaagacatcatgcaaacggaaaaagttcccgttcaaaggatgtcggtccgctaatgagaaagaagatgcattggcttctatatggctggaagctgcttatgttggccgtactgacggcggctgtcttttcttatgccatgtttcagggcggatttgtgagctggtttttattttatgcgtttttgccgtttaccgtttacgccgggctggtcgctgtgtacccgctgcgggcgtttcaggtgacgcgtgacgtgtcctccgcccagttaacctcaggcgacaggctgtctgtcaccatcaggctgacgaggcgcctgccgtttccgctgacatatatggtcattgaagatgtgatgccggaaacgcttggcgagaggcgcagtgcgaaacagcttgtgtttccgtggtttcaaaggaagctgatgttacaatatgagctgccgcaggtgccgcgcggagagcatcatttacatacgatcagagtgcggacgggagatgttctcgggcttttggacaagacggcgtcgttttccgtaacggatacggttctggttttcccggcgtacgggcctgttcactataagccgcaggctgcatcaggagaagagggtgcgggtgccggcgctccgtttcaggtacaccgcacagcaatggctgcgagcgtcagaaattatcagccgggcgaccggttttccgcacttgactggaaaacatcggcgcggcgaaatgaactgatgacgaaggaatttgacccgctgcagagtatgaatatgattctccttttggactgcaggccgtccccttcgtttgaagccgcggtgtcagcttcggcatccctgctttacacggcgcttgtgaagggctctcccgcaggatttatttcattggggagcgaccggactgtatttcccgtccgggagggagagcggcatttcagacagatgctgcgttacctggcatcagctttagaatcggaagaagccgatgcaggcgggcgtttagggaaagaactgggtaaagcttccgttgccgtcgtgacgggcagtcttacagaagaccttctcaaacaggctgatcccggccgtgctgacatgacggtgtttttggcgaaagaaacgaatgccgcgctttcggagaaagaacggaaactcgctctcatcttcgctcagaaaaatattaaggtgcaaatgatcagggacaaacgggtgtcccatgttgtttagaaagagaggtggcgcgccatgccgcatgacgagaaccagggaagcaggctgagtctgctgctgttttattttctcgcttttttattgttatgggaatggctcaggccgctgcacaattttacggatacaaaacataccggttttttcatcgtttttatcggtttggcatttctgctgtcattcttccggatgaggtggtacgtcaccgtgccgtcctgcattctgtttacgttgatcagtattcacatcctgttttataaaggttctatttttcagccggaatggctcgtttcttttttgcgggacgtgatgcaaaatgcccgccacatcggaaccggaagatggaatgatatgaatccgtcattccgcacgttgctgttttttgtgcttttatggctgctcgtgtatttgctgcattactgggtgatctatcagcggaaaatattattcttttttatcatgacggtggcgtatatcaccgtgcttgatacgtttactccttatgatgccgcgtacgccgtcatccggatcgtctttatcggctttttgatgatggggcttttgtatatggagcgcatccggcttacggaacacatagcgtttaaaaaaagattgatactcaaatggtttctgccgctgatgctgtttatctgcgcttccgtcgtgttcggtctggcggctccgaaatcagacccgaactggccggatcccgtgccgtttctaaaaaaaatcacaaaccacaaagaagtgcccgccgccgaaagcaaaatcggctacggcaatcatgatgaaacattgggcggtccttttcaggaggatgatacgccggtttttacatggaagggaaaagaacgggcgtacttccgggtggaaacgaaagatacatacacggggaaaggctgggtggagaccgatcagggcatgtcctataaactgaacggcggcaatgtggaagatgtatggtttgaccggagtgtgcagacgagacggtatacggcacaggtgtccattgatgagaattatctctataatcacgtcatgtatccgatcggcgtctccaatattaaaccgaagcactcgattcagcttgaaatgaacggaaacaccgagcaaattacgccggtcagtgaacaagtgggcaacatccgcaatatgggacggtacacggtgacttttcaggcgcccgtctttaagctgaatgatctcagaaaagtgaaagtgaaacgataccgtgagcagaatcaattcaatgaccggtatttacaggtccccgacagtcttccgggaagagtgagacagcttgcggacagactgacgcggaatcatcataatatgttcgataaagcgaaggcgatcgaggattatctcggatcttccgcattttcgtataatacacaggatgtcgcggttccggagcacaatcaggattatgtcgatcaatttctgtttgaaacgaaaagaggatattgtgataacttttcatcggcaatggcggtgctgctccgctccgcgggaattcccgcccgttgggtgaagggctatacatccggcgaatataaaggggcaggcgaccataacggccacatttatgaagtcacaaacaacaacgcccattcgtgggtagaagtgtattttcccgatcagggctgggtgacgtttgagccgacaaaaggcttcaccaatccgacggagtttacgtcagagcaaaatcataccgcggcaaaagacagcggaggctcagcggggggttcggattcaccgtctgacaagcagcgtcaggaaacaaagccggaaaaagaagaaacaccgaaaaagcgggatcacagcgcggcaccgcatcctgtgatccgcaacaaaaccgcggcacacctgtggccgtatgcagccatcgtcatcgtgatttcagccgcggcggcactcgtctggctgttccgggcgcgctggattccgcacgttacagcagccagattgaagcggcgaacggatgaagacgtctttttcgacgcatatgccgcgctgctccgccagctgaaacgaaaaggtttcagcaggggagacggagaaacactccgcgattttgctgcgaggattgacgaggcgcaccatacaaacgacatgtccgagctgacgctgcgctatgagcgggccttataccgcagggataatgccgcaaagctttggaatgaatcgggacagttgtgggaaaatataattaaaacaagatagtcttgaccgcatatcgtcctgttgttagaataaatgaatgttaaatgggagcccgggagcgttaaaaagccgggcttccggacaagtcttgcgcgacagagggctgaacgtttgtcctccgttttttctgtgtcaaaaacttagaggagattaggtgacaaccatgacgaagttagtgaatgaaatgattcttgttcttgatttcggcagtcagtataaccagctgattacccgccggatccgtgaatttggcgtatatagcgagctgcacccccatacgttgacagctgaggaaatcaaagaaatgaatccaaaaggaattatcctttcaggcggaccgaacagtgtatatgatgaaggatctttccgctgtgacgaaaaaatctttgaactcgatattcctgtattaggcatctgctacggcatgcagctgatgactcattatctcggaggaaaagtcgaggcggcaagccagcgcgaatacggaaaagcgaacattcagattcaaggaactcctgacttgttcaaggatcttccggaagaacaagttgtctggatgagccacggcgatttggttgtagaagttccagagggcttcactgttgacgcaacaagccatcactgcccgaattcagcgatgagcaaagcggacaagaattggtacggcgtacagttccacccggaagtgcgccactctgaatacggcaatgatcttctgaaaaactttgtcttcggcgtttgtgattgtgaaggcaaatggtcaatggaaaactttatcgaaatcgaaatgcaaaaaatccgcgaaacagtcggagacaagcaggttctttgcgcgctaagcggcggtgttgattcctctgttgtggctgctttgattcataaagcgatcggcgaccagctgacttgtattttcgtcgatcacggcctgcttcgtaaaggcgaagcggaaggcgtcatgaaaacgttcagcgaaggctttaatatgaatgtcattaaagttgatgcgaaagacagattcttaaacaagctgaaaggtgtttctgatcctgagcaaaaacgcaaaatcatcggcaacgaattcatttacgtgtttgatgatgaagcggacaagcttaaaggcatcgattaccttgcgcaaggaacgctttacacggatattatcgagagcggtactgcaacggcgcaaacgatcaaatctcaccacaatgtcggcggacttcctgaagatatgcagtttgaactgatcgagccgttaaacacgctcttcaaagatgaagtgcgcgcgcttggcacagagctcggccttccggatgatatcgtatggcgtcagccgttcccgggccctggacttggcatccgcgtactcggcgaagtaacggaagaaaaacttgaaatcgttcgtgaatcagacgcgattctgcgtgaagaagtggcgaatcacggccttgagcgcgacatctggcagtacttcacggttcttcctgacatccgcagcgtcggcgtcatgggagatgcgagaacgtatgattacacaatcggtatccgtgccgtaacatcaatcgacggcatgacatctgactgggcgcgtatcccttgggatgtgcttgaagtgatttcaacacggatcgtcaacgaagtgaaacacatcaaccgcgtcgtgtatgacattacgagcaagccgcctgcaacgattgagtgggaatagtcaaaagaagcttagaatccttggtttataagggttctaagctctttttttcttttatagcaacaattgatccaatattattaattgaaccgtgaattttaaaaactctcttggaacaagtattccttaatgagataataattaatgttgttttagaataaggtttgttcaaattaagcaaattaaaggaacctccttattcaaatacaaccatttcaccgacatctgtaaatccaaatcgcttatagatattttttccatcatctgaagcctgtaataccactggtttttgtttatcctttgtttgatttagaagaaattgaaacatttcactgccaattcctttacctctaaatgtttcttttgtcatcacatcataaataccatagctatctttggtttctattaataaaccagtagttacaggcatttcatctatgcatccaataaacatttgaacttctgaacctaattttacttgtgaaaacctattaaaataactttctaatgcatctttttctggtgttccctcaaataagctcatgaatacgtctatatattttaaaagttcttcatcatttttcacagcagtaatcataagctgatgggaaattctttgcccggcattaagagtattttcaagtttcatcattacattacgttccgcttcttttagatcatattcttgtataagtttagtccaatcctcagttaaatactgagcatcaatccaaatactaaagggatattttttatatgaaaaattatcgattccatgtctgatcttaactgtatttttgatatttggagatttcggcaatattacattgaatgtatcagtaggaatttttgtatttgctatgatgaaatcttcttcctttgtaagctctccgctaactgtatgagtaaatgattttaatttttcttccaaattgtttatgactaattgttgatttgtaatcatgtttttgcacctttcaatttgatttagtgcgctttttttattataaggtcaactaaaacactaaaaatacagtgttcacagtatttcccccctcccataatattcagaacacggggggcaatatttttatggtaacttctaaatgaaggaactgcaaacccccaaaaggcttgatattcaataaattaattcttataatgtttagaaagcattgagtgggaataaatgaagataaaaaacgcctctttttaaaaaagaggcgttttttttttatctttttgaaaccgttttgctccgattcatatctaacagcataggaggtggataaggtgaaggaagaacgattgatcaaaaaggcgaaaaaaggtgatgcctcagcctttgaaaaactgatcacaacccatcaggagactttatataaaacagcttatctctatttgcatcacaaggaagatacactggacgcagtgcaggaaacggcttacaaggcttttcttcatatcgcgcagctgaaggagccgaaatattttaaaacgtggctgatccggattctgcttcatacgatttttgcgatgaggaaaaagcacggagacgtcattccgtttgagccgcagcatgatacgcgcgcggagaataagaacattgaagaatacatagatcttcggaatgccctggaaacgcttgacgaacatatacagctgaccattcagctttattattttcaagatttctcgattgctatgatcgctgaacagaccggaatggcggaaggcactgtaaaaacgcatctgcacagggcgagaaaagcattgaagcaggagctggaaaaggaggataaacacatatggaaaagcatcaaatgaagcaattgtatcagaacattgacgtgccgaaagctgaattgaaaaacgtgatacatagcgccgctgtccgtgccggaaaagaaggcgccgtcagacggagatggggacgaaaagtgataaacggccttgcggttgctgctgctttgtttattctgtatctgtcctcaggcttgttcatgccctccgttaatacggctatgggaaacattcctgttgccggacaaatttacagtctgtttcaggataaggcaggttctgcgctgtttaaaagcaatttggtgacaaaactgaacgagaaagcggaatcacgcggaatcacggtgacagtgaaaagtgtgtattacgacagcggacagctcgtttacaattttatcgttgataatttgaaatcagatgaggagagcatctcttttcaagttgattataaagatccacggaatatgttagcagaggattatgacagcagtgatatgaaaaaaatgaaagacgggcagtacgcggggcagcttcgcctgttcacggacggctcaaagctgaaagacggtgataagcttccgcttgtcattacacaaatcaaggatatccctggaaactggcgctttacacttccgatcaaaaaacaaaagtccgtttctcttgaaggaacgaaagctgtgaatgtaaatcacggattataccgctttttcgatatccgggcggaaaacggaacgatgggatcggctctcctgtattctatcgacttctatgatgcagctaaaaatgataccatctcgattgacgaagcaacggatgatgctggaaaccattatgaaatgacgatgtcgaatattgaacttggcggaaggaagaatcttcctggcggcgggaaaagaatacgcggccaaactcaattcagcaaaccgatagacccgaaagcgaaaacacttttcataacgggcgatataaaaacagaatcagagccgggagaaatcgtgcctctgaaaacaaaactgcccgtcagttataaaacgaaacatcatcatgtcggcatcaccatcaaaaagatcaaacagcaagacagacgggtaattgtcgattatcaattcagcggaattgatgtaagcaaggcggatgaagatcagctgatgaatgtcggtgaatcaatcggtctcggcaatacgaaaaaaatgaaaacttggccatcgcttaatgagtatgaaaaaggctattatctgaaagggaataaggcgaaagtcacgaatcttaaaacgggtgaaatggaatccgtttttgaattagatgattcatccgataaagactattcattgcgcgatttctcattcgattcatatgctttgtacgtcaatcaaacggttatgaacttgctggcggatgacaaggggatcatattcgcggtgccggttcggcctgcggacggaaaataatgtcgggaaggcggcttttgccgtcttccatttttggtcaattaacgaataaaccaaatttttttaacgggattgttcgttttttttattgagttttcaaaattgaattgatacaatagactcagaaatcaaatatgcagatatcgtataatggcggggatatggcccgcaagtttctaccaagctaccgtaaatggcttgactacggatcaatctcaatcgtttgatataaataatccattcttatttattcagactgaacgtatgtagtcaagcgtcccaaaatgttatttggggcgttttttatttggcggataacgggcagaataaatgggagagaatgaaggaggcaattggcttgaagcaattttttcagtttgatgagctggggacaagctatcgtaatgaaatcatcggcggtttaacgacctttttgtcaatggcgtacattctgttcgtcaatccgctgacattgtctttaaacggtgtgaaaggatttcccgaagcattaaaaattgatcagggcgcggtgttcaccgctacagccttggcatctgcggccggctgtattttaatggggcttattgcaaagtatccgatcgcgattgcgccgggtatgggattaaatgcgttttttgctttctctgtcgtactcggcatggggatttcatggcaggctgcgctttccggcgtcttgatttccggaattatcttcgtggcgctttcgctgacgggattgcgggaaaaaatcattaatgcgattccgcctgagctgaaattggcggtcggcgcgggtatcggtttgtttatcacatttgtcggtttgcagggttcgggcattattgaagcgaactcatcgactttggtgtctatcggcaatattcacagcggccctgtgctgctgacggttttcggtgttattgtgacggtcattctgatggtgcttcgcgtaaacggcggcgtgtttatcggaatgcttctgacggcggttgccggtatgatctgcgggctgattccggttccgacacacattgtcggcagcgtgccgagtcttgcgccgactttcggacaggcgtggatgcaccttccggatatcttctccgtacaaatgctgattgtcattttaactttcctgttcgtcggatttttcgatacggccggtacgctggtagctgtagcgacacaggccggactgatgaaggaaaacaaacttccgcgcgcgggaagagcgcttctggcagattcaacatcaatcgttatcggagccgtgctcggtacgtctacaacgacttcttatgttgaatccagctcaggcgttgcggcgggggcgcgctccggcttcgcggctgttgtgacgggcattctctttttgctggcgatgtttttctcgccgcttctgtcagttgttaccacgaatgtgacggctccggctttaattatcgtcggcgcgctgatggtggcgccgctcggtaagatcgcctgggataaattcgaggtggctgttccggcatttttaacgatgattatgatgccgctgacgtacagcattgcgacggggattgcgatcggttttattttctacccgattacaatgatctgcaaaggaaaaggaaaaagcgttcacccgattatgtacgggctgttcgtcatctttatcctgtatttcatcttcttgaaataacggaaaaaccggctgaggacagccggttttttgtttttgtcctattccgtaaaaccaatacatactataaaacgtcatgtgggtgtccgggtgaagaaaaccgcttgactgtttaaggccgcttcggtaccttatataagtgttttattttcttgctaaacaaattccgccgtatttttttgataggagttgctgacatgacggaagaaagaaaagaaacgttggaagaagaaaaacagcatcagggaactgatgaagaaccgctgtcgagaatgtccagaaatgcgggacgttatcaaaagcaaaagaaaaaagaaaaggaacggcgcccggctccggcttttacagaaaaactcgcttctgcatgggccgcggtcaaacgttattgccgtttcgcgctgcgcattttgacatcaccggtgaaggtcgttggggaagacggcttttcccgctttaaatatgctcttatttcaatgcttgtattcagtatctttttctcaatcggaaattggtttcagctgagggcaagccagcaaaggcctctcggatacggggagcggcatcatacgttttttgacggctttaccgtcgttctcgtgtacacgctcgtcttttttgccgctgcggcgggcgcggtctggcttgtatcacgttatatgatgaaacagaaaattacgatgcgggatgcggccgcgggggtcggatcgcttttggttccggctgtcgcctgctctatcgtgtggatgattttcgcgatattgaatctgccggtcatcaccgtggtgtttacggcgctgaccttgtttctggccgcctcggcgatggtgcagtttgtgcagattctatacaaatcggctgaaaagcctgcggctgacgtgatgtactgtatttccgcggcggtcatcatcatgctcgtttttacggctgtgacatggccgctcatttccgagtactttactgcttcgctgattcctttataagtcgaaatttgtctttcacaatgtttacaaatttttctaataaagcgtgttgttttgaggacccggccgagatatgatgagagcaacagcaattcgaaagcggcactactctttatgattcggaaagggatgatgaagatggccccgttgttgcgagaagccattaatcggaaaaaacagcacctgaggacaaaactgatccgctcagggttttatcaagaccatgttcaggaactgtccggatacacgctgagtgaacttgagaaggaatatgaagctgtcaaacgattgaaaaaagccgagcttcactgataagagcttgaaagtctgccttgcggggcgggcttttttttcttttgaaaatgatgaaaagagggtaaactatccttaattgaaagattggcttttcaaagtcagaggaggggaatcagtgatgcagacaattttatccaacagtataggtatggttctcattattctcatcattaacattatatatgtctctttctttacgatcaggatgattctgacattaaagggacagcgctatttcgccgcaggcatcagtacgattgaaatccttgtgtatgtgaccggcctgagtctcgttctcggcaatctgaatcaaattcaaaacgtcattgcctatgcgctcggctacggcctcggcgtcatagtgggaatgaaaattgaagaaaaactggcgctcggctacataacagtcaacgtcattacgaaagagcttgatctggacctgccgaaacagctccgggaaaaaggatacggtgttacaagctgggttgcgggcggacttgaaggagaccggaccgccatgcagattctgacgccgcgcaaatatgagcttcagctttatgatacgattaaaacgcttgatgaaaaagcgtttatcatcgcctttgagccgaaaacgatccacggcggattctgggtgaaagcagtgaagaagaggagaattaaggaatgacaaagccaaaaaagaaacggtttgaagtaacggaagatgaaacgattgacaccattctcactttaatgaaggaagagggttatacgcccgtccggcggatggaagagccgatctttacagaaaagaaagaaaatggatcaattcaagtcgttccttgcgggaaaaaaatcgtatttgaagggaaattgatctaaacacgaacattaaaagaaagaatttttatatcgttcgataatgtcgttgacattatccaagtccgttgttaagataaacatgaaatcaaaacacgacctcatataatcttgggaatatggcccataagtttctacccggctgccgtaaacggccggactatgcaggaaagtgataaacagctgacatggatatcgcagaagcgaacgactgacgatacgcgcgccatgcccggtttgtattgcttcctcatagttgcaatataagccgggcttttttttctgaaaaacaaagcatgagaaggtgggaacagaatgcagccgctagcaggaatcatcatgggaagcacctccgattgggagacaatgaaacatgcatgcgacatacttgacgaacttcacattccttatgaaaaacaggtagtatccgcgcatcggacgcctgatttgatgtttgaatatgcagaaagcgctagagacagaggcttaaaagtcattattgccggagccggtggagcggcgcatctgccgggtatgacggcggccaaaacgacactgccggtgatcggcgtaccggttcagacaaaatcgcttaacgggcttgattctcttctgtctatcgtacagatgcccggcggcgtgccggtcgcgacgacggcgatcggaaaagcgggcgcagtgaacgcgggtctgttagccgcgcagattttgtcggcatttgacggtgacattgcggataaactagaggcgagaagaaatgcgacaaaacaaacggtgctggaaagcagtgatcagcttgtctgataaaaaaacgatttatcccggcgccgtcatcggcattatcggaggcggacagctcggaaaaatgatggctgtcgccgcaaaacagatgggctataaagtcgcagtcgtcgatcccgtgaaagactcgccatgcggacagatcgccgatattgagattaccgcccagtataatgaccgtgaagcgattcaaaaattggccggagtcagtgacatcattacgtacgaatttgaaaatatcgattacgaggcgctcaactggctcaaagaacatgcatatcttccccagggaagcgagctgctgcttatcacccaaaatagggaaacggaaaaaaaggcgatccagtcagcaggctgtcaagtcgctccttatcggatcgtaaacagcggacgggagcttgaggaagctgttcaggcactggggctcccggctgtgctgaaaacatgccgcggcggatatgacggcaaaggccaatttgtcattaaggaagaaggacagacagatgaagcggccgcgctgctagaaaacggcacgtgcatactggaaagctgggtatcattccggatggagctttccgttatcgtgacgagatcggtgcacggtgagatttcaacctttccggctgctgaaaatatccacaaaaataatattctgttccaaagcatcgtgcccgcgagagcggaggaaacggttcaaaagcgggcagaggcgcttgccgttcagctcgcggagaaattggagcttgtcgggccgcttgcggtggaaatgttcgttacggaagacggagaccttttgatcaatgaactggcgccgcgtcctcacaactccgggcattatacgctcgacctttgtgaaacgagccagttcgaacagcacatcagagcggtctgcggacttcctctcggcagaaccgatcttctcaaaccgggaatgatggtgaatctgctcggtgatgaagtgaagcttgcggaggagcatacggagcttttaaaagaagccaaactgtacctgtacggaaaacatgagattaaaaaaggccgcaaaatggggcatatgacatttttgcggaagcctgatgaaacatggattcaggacatcacgaacatatggatgaaaagagacggaggacgagcataatgatcgaacgttattcaagacctgaaatgtccgcgatctggacggacgaaaacagataccaggcatggctggaagtcgagattttagcctgtgaagcctgggctgagcttggcgtcattccgaaagaagacgtcaaggtcatgcgcgaaaacgcgtcttttgacatcaaccgcattttggaaatcgagcaggatacgcgccatgacgtcgttgcatttacccgcgcggtttcagaatcattaggcgaagaaagaaaatgggtccactacggcctgacgtcaacagatgtcgtggataccgctctttcctatctattaaaacaggcgaatgagatcttgctcaaggacattgagagatttgttgacattataaaagaaaaagcgaaagaacataaatacacggtcatgatgggccgcacgcacggcgtacacgcggaaccgacgacattcggcctgaaactcgcgctttggcacgaagaaatgaaacgcaaccttgaacgtttcaagcaggcaaaagaagggatcgaagtcgggaagctttccggcgcggtcggcacatatgcaaatattgatccgttcgtagagcagtatgtctgcgaaaaactcggcctgaaagcggcgccgatttccactcagacattacagcgcgaccgtcatgcggattacatggcggcactggctttgatcgcgacgagcattgaaaaattcgcagtggaaatccgcggtctgcaaaagagtgaaacacgtgaagtggaagagttttttgcaaaaggacaaaaaggctcatcggctatgcctcataaacggaatccgatcgggtcggaaaatatgacgggcatggcgcgcgtgatccgcgggtacatgctgacggcatacgaaaatgtaccgttatggcatgagcgtgatatttctcattcatcagctgaacgcatcattcttcctgacgcgacaatcgcgctgaattacatgctgaaccgattcagcaacatcgtcaaaaacttaacggtattcccggaaaatatgaaacgcaacatggaccgcacactcggtttaatctattctcagcgcgtgctgctcgctttaatcgacacgggtctgcctcgtgaagaagcatatgacacggttcagccgaaagcgatggaagcttgggaaaaacaagtgccgttccgccagcttgtcgaagcggaggaaaaaatcacgtcccgcctcacacaggaacagattgccgattgctttgactacaattatcatctgaaaaacgtcgacttgatctttgagcgtttaggtttatagaagaagccagccggaggcggcttcttcagccgccgtagattgaatattcccaacattcgggttaggaggccttccgtgaatattgtgaacaataatcttctttatgaaggaaaagcgaaacgaatttatcaaactgaagacgaacagattctccgcgtggtctacaaggattccgcaacagcctttaacggtgagaaaaaagcggagatcagcggaaagggccgtctgaacaatgaaatttcaagcctgattttcaaacatctgcacgccaaaggaattgacaaccactttgtggagcgtgtttcagaatcagagcagctcatcaaaaaagtgagcatcattccgcttgaagtcgtggtcagaaacattgccgccggaagcatgtcgaaacgtctcggcatcccggaaggaacagagctcccgcagccgattatcgaattttactacaaggatgacgcactgggtgatccgctcatcactgaagatcatatctggctcttaaaagcggcggctcctgagcaggtcaaaacgatcaaatcgattacaaaccaggtgaatcaagaactgcagcatatttttgaagactgcggcgtcagattaatagattttaagctggaattcggcttagacgcagagggacgggtgcttttagcggatgaaatttctcctgacacgtgccgtctgtgggacaaagacacaaacgaaaagctcgataaagatttgttcagacggaacctgggaagcttaaccgacgcatatgaagagattttcaaaagactgggaggcatttcataatgtataaagtgaaagtttatgtcagcttaaaagaaagtgtgctcgatcctcaaggaagcgcggtgcagcatgcattgcacagcatgacctacaatgaagtgcaggatgtgcgcatcggaaaatacatggagctgacgatcgaaaaatctgaccgcgatcttgacgcgctcgtgaaagaaatgtgtgaaaagcttcttgccaatacagtcattgaagactaccgatatgaagttgaggaggttgtcgcacagtgaaatttgcggtgattgtgttacccggctccaactgtgatattgatatgtttcacgccgtaaaggacgaactcggcgaagaagtcgagtatgtctggcacgaggaaacaagccttgacggatttgacggcgtactcatccccggcgggttttcatacggcgactacttgagatgcggcgccatcgccagattcgcaaacatcatgccggccgtgaaaaaagcggctgccgaaggaaaaccggttctcggcgtctgcaacggattccagattctgcaggagctcggacttctgcccggcgccatgagacgcaacaaagatttaaagttcatctgccgcccggttgaattaatcgtgcagaacggcggtacgttattcacatcttcctatgaaaaaggacaatcgataacgattccggttgcccacggcgaaggcaatttttactgtgatgacgaaacgcttgaaagattaaaagaaaacaatcaaatcgccttcacatacggcggcgatattaacggaagcgtcagcggcattgccggcgtcgtgaatgagaaaggcaacgtattaggcatgatgcctcaccctgagcgcgcagtcgatgaactgctcggcagcgcagacggtcttacattgttccggtctatcgtgaaaaattggagggaaattcatgtcgctactgcttgaaccaagtaaagaacaaataaaagaagagaaactctatcagcaaatgggtgtcagtgatgacgagttcgcactcattgaatctattatcggaagattgccgaactacacggaaatcgggattttttccgtgatgtggtcagagcactgcagctataaaaactcaaaaccggttttacgcaaattcccgactagcggcgaacgcgtgctgcagggtcccggagaaggcgcgggaatcgttgacatcggtgacaatcaggcggtcgtgttcaaaattgaatcgcataaccatccgtcagcgcttgagccataccagggtgctgcgacgggagtgggcggcattatccgtgacgttttctcaatgggcgcccgtccgatagctgtattaaactctcttcgatttggtgaactcacttcacctcgtgtgaagtacttgtttgaagaagtagtggcgggaatcgcgggatacggaaactgtatcggcatcccgacggtcggcggagaagtgcagtttgacgcaagctatgagggcaatccgcttgtcaatgcaatgtgcgtcggcttgattgatcataaagatattaaaaaaggccaggcgaaaggtgtcggcaacacggtcatgtacgtcggcgctaaaacgggccgcgacggcatacacggcgctactttcgcatcagaagaaatgtcagattcatctgaagaaaaacgttctgcggtgcaggtcggcgatcctttcatggaaaaacttctcctggaagcatgccttgaagtcatccaatgcgacgccttagtcggcattcaggatatgggggcggccggtctgacaagttcgagtgctgaaatggcaagcaaagccggctccggcattgaaatgaatcttgatctcattccgcagcgggaaacgggtatgaccgcttacgaaatgatgctttccgagtctcaggaacgcatgcttctcgtcattgaacgcggacgtgaacaggaaattgtcgatatttttgataaatatgatcttgaagcggtttccgtaggtcatgttacggatgataaaatgcttcgcctccgccataacggagaggttgtttgcgaacttccggtcgacgcactggcggaagaggcgcctgtataccacaaaccgtcagcggaacctgcgtactaccgcgagtttcaggaaacagaagttgccgcgcctgaagtgaaagatgcgacagagacgctttttgacctgctgcagcagccgacaatcgccagcaaagagtgggtgtatgatcaatatgactacatggtgcgcaccaatacggtggtcgctcccggctctgacgcgggagtgctcagaatccgcggcacgaaaaaagcgctggcgatgacgacggattgcaacgcccgttatttatatcttgatccagaagaaggcggaaaaatcgccgttgccgaagcggcgcgcaacatcgtatgctccggcgccgaaccgcttgcggtcacggataatctgaatttcggaaacccggaaaaacctgaaattttctggcagatcgaaaaagcggccgacggcatcagcgaggcgtgcaatgttctcagcacacccgtcatcggcggtaacgtatcactttataatgaatcgaacggaacggccatctacccgacgcctgttatcggcatggtcggcttaattgaagataccgctcatattacgacacagcatttcaaacaagcgggggatcttgtatacgtgatcggcgaaacaaaacctgagtttgccggaagcgaactgcaaaaaatgacagaaggccgcatttacggcaaagcgccgcaaatcgatcttgatatagagctgtcacgccaaaaagcattgcttgacgcaattaaaaaaggcctcgttcaatccgcgcatgatgtgtctgaaggcggcttaggcgtagcgattgctgaaagcgtcatgacgacggaaaaccttggtgccaacgtgactgttgaaggggaagcggcattattattctctgaatctcaatcccgcttcgtcgtttcggtcaaaaaagaacaccaagcggcgtttgaagcagctgcggctgatgcggttcatatcggtgaggtaacggctgacggacttctggcgattcaaaaccaggacggacaacaattggttcacgcgcaaacgaaagaacttgagcgcgcgtggaaaggagctattccatgcttgctgaaatcaaaggcctgaatgaagaatgcggtgtgtttggcatctggggacatgaagaagccccgcaaattacgtattacggcctccacagcctccagcacagaggacaggaaggcgcgggaattgtcgcgactgacggcgaaaaactgacggcgcacaaaggccaagggctgatcactgaagtatttcaaaacggcgagctcagcaaagtaaagggaaaaggcgcgatcgggcatgttcgttacgcaacggctggaggaggcggatatgaaaatgttcagccgctcctgttccgttcgcaaaacaacggcagccttgcgctcgcccataacggcaacttggtcaacgccacacagttgaagcagcagcttgaaaaccaagggagcatttttcagacttcctccgatacggaagtgctggctcatctgattaaacgcagcggacacttttcgctgaaggatcagatcaaaaattcgctgtctatgctgaaaggcgcttatgcctttttaatcatgacagaaacagagatgattgtagcgcttgacccgaacggactcagaccgctgtcaatcggcatcatgggcgatgcttatgtggtcgcttcagaaacgtgcgcatttgacgtcgtcggcgcaacgtaccttcgcgaggtagagccgggcgaaatgctgatcatcaacgatgaaggcatgaaatcagagcgcttttccatgaatatcaaccgttccatctgcagcatggagtacatttatttctcaagacctgacagcaatatcgacggcattaacgtgcacagcgcccggaaaaacctcgggaaaatgcttgcccaggagtccgcggttgaagcggatgtcgtcacaggcgtgcctgattccagtatttctgcggccatcggctatgccgaagcaacgggcatcccgtacgaactcggtctcattaaaaaccgttatgtcggcagaacgtttatccagccgtcacaggctctccgtgagcaaggcgtcagaatgaagctgtccgccgtccgcggtgttgtcgaaggaaaacgggtcgtcatggttgatgattccatcgtgcgcgggacgacaagccgccggattgtcacaatgctcagagaagcgggggcgacagaggtgcacgtcaagatcagttcaccgccgatcgctcatccgtgcttctacggcatcgacacatcaacccatgaggagctgatcgcttcctctcattccgtggaagaaatccgtcagatcatcggagccgacacgctttctttcttaagtgtagacggattgttaaaaggagtcggccgaaaatttgaagacaccaattgcggacaatgcctcgcttgttttacgggcaaatatccgacggaaatttatcaggatacagtgcttcctcacgtaaaagaagcggtgctgacaaaataaaatgtgaaaatgacataaaggcagcgggaattcaggctgcctttctctttctgccttttaaggagaaacgaattgacaaggagtgatagggatgtctgatgcttataaaaatgccggagttgacatcgaagccggatacgaagccgtcaaacgaatgaaaaaacacgtggagcgcacgaaaaggctcggcgttatgggaagcctgggtggttttggcggaatgtttgatctgtcagagcttccgtatcaaaagcctgttttgatttccggaacagacggtgtcggcaccaaactgaaactcgcattttcaatggataagcatgacacgatcggcgtcgatgcggtcgcgatgtgtgtaaacgatgtgcttgcccagggagcggagccgctgtttttccttgattatttggcggtcggcaaggctgatccggtgaaaattgagcagatcgttcagggtgtggcggacggatgcgagcagtcaggatcagcgcttatcggcggtgagacggcggaaatgccggggctgtatacgtctgatgaatacgatattgcgggcttttcagtcggcgtcgcggaaaaagacgaaatcgtcaccggtgaacatatcgaagaggggcatctcttaatcggacttacttcaagcggccttcacagcaacggattttccctggtgagaaaagtgcttcttgatgacggcggacttgatttggatactgtctatgaaccgtttgcgcgtcctctcggcgaagaattgctggaaccgacgagaatatatgtgaagccggtgctcaaggcggtgaaaagcggtaaggtggacggcatggcgcatgtgacaggcggaggattcatcgagaatatcccgcggatgctgccggacggattgagcgcggaaattgatcacggatcatggccgatcccgccgatttttccgtttctgcaggagcacggcaagctgaaagaagaagaaatgttcaatgtttttaatatgggcatcggttttgtccttgccgttaaagaagaaaacctgacagacgtcatcggcacgcttgaagctcagggcgagaaggcttatctgatcggccgggtcaagcggggcgaaggcatttctttcggcggtgcggctctttcatgaaaaagtttgcggtatttgcttcaggaaacggatcgaacttcgaggccattgccaaacgcatgagagaagagaagtggaatgcggagctctcgcttctcgtgacggataagcctcaggcaaaggcggtggaaagggcggaggctttacatatcccgtcattcgcctttgaaccgtcatcttttgaaaacaaagcggcctttgaacgggccattattgaacagctgcgtctgcacggggcggaattaatcgttctcgccggctatatgagactgattggagatacgctgcttgaagcatacgggggccgcattattaatatacatccctcgcttcttccggcattccctgggattgacgctgtcggacaggcgtatcgggccggtgtgaaagtggcgggcattaccgttcattacgtcgacgaaggcatggacaccgggccgattatcgcgcaaaaagcattcgaaatacaggaaaacgatacgcttgaagacatagagcatacaatacacgagcttgagcacaaatggtatccgagcgttgtgaaacggctgctgggactaaataacagaggtgaaaaggcatgacaatcaaacgcgcactaatcagtgtttctgataaaaaaaatctcgtacctttcgtaaaggaactgacagagctcggcgtcgaagtcatttcgaccggaggaacaaaaaaacttcttcaggaaaacggtgtggatgtcatcggcatttcggaagtgaccggatttcctgaaattatggacggacggttaaaaacgctccatcctaatattcacggcggtctgcttgccgtaagagacaataaagagcatatggcgcagatcaatgagcatggcattgcaccgattgaccttgtggtcgtcaacctttatccgtttaaagaaacgatttcaaaagaagacgtaacatacgatgaagcgatagaaaacattgatatcggcggtcccggcatgctgcgcgccgcatcgaaaaaccatcaggatgtgacggtcatcacagatccggccgattacagctccgtgctcaatgagatgaaagaacacggcggcgtttcgctcaaaagaaaacgcgagcttgcggccaaagtattccgccataccgcggcatacgacgcattaatcgctgattacttaacacgcgaggccggtgagaaagaccctgagcaattcactgttacttttgagaaaaaacagtcgctccgctacggtgaaaaccctcaccaagaggcggttttctaccaaagcgcacttcctgtctccggttccatcgcagcggcaaaacagcttcacggcaaagagctttcttataacaatattaaggacgcggatgcggccgttcaaatcgtccgggaatttacagaacccgcagctgttgccgttaaacatatgaatccatgcggagtcggtacgggagcttcaatagaggaagcattcaataaagcgtatgaagctgataaaacctccattttcggcggcatcatcgcgctgaaccgtgaagttgatcaggcaacggctgaagcccttcacggcatctttttagaaatcattatcgccccttctttcagtgaagaagcgctgaacgtgctgacggcgaagaaaaaccttcgtctgctcacgcttgacgtgaccgcatcaggaaagaaagaaaaacagctgacttccgtacagggcggtcttttgattcaagatttagacgtccatggatttgatgacgccgacatcagcatcccgacaaaaagagagccgagcgagcaggaatgggaagatttgaagctggcctggaaagtcgtcaaacacgtgaaatccaacgcgatcgtccttgcaaaagaccatatgacggtcggtgtgggcgcaggacagatgaatcgcgtcggttcagccaaaatcgccattgagcaggccggagaaaaagcaaaaggcagcgcgctcggatcagacgcgtttttcccgatgccggatacagtcgaagaagccgcaaaagccggtgtcacggcgattatccagcccggcggatcggtccgcgatgaagattcgattaaaaaagcggatgaatacggaatcgccatggtattcaccggcatcagacatttcaaacattaagggggaacgaagcgtgaatgtattgattatcggaaaaggcggcagagagcatacattggcttggaaagcggcgcaaagcccgcttgttgacacggtgtacgccgcgcccggaaatgacggtatggcagactgcgcgacgctggtcaacattgaagaaagcgatcatgccgcactcattgcgtttgcgaaagaacatcatgtcgggctgacgattatcggccccgaagttcctctgattgaagggatagccgacgagtttgaaaaagccggactgcttgttttcggaccgtctgaaaaagcggctattattgaaggaagcaaacagtttgccaaggatttaatgaaaaaatacggcattccgacggcggagtatgagacgtttacttcatttgaagaggcgaaagcatatgtacagcaaaaaggcgcgccgattgtcattaaagcggacgggcttgccgccggaaaaggtgtcacagtcgcgatgacggaagaagaagcgattgaatgcctgcacgattttcttgaggatgagaaattcggggaggcgagcgcatctgttgtcattgaagagttcctcgccggcgaagaattttctttaatggcgtttgtaaaaggggagaccgtctatccgatggtcatcgctcaagatcataaacgcgccttcgatggagacaaagggccgaatacgggcggaatgggcgcctactcaccggtgccgcacatttccgatgatatcgtcagaagcgcagtcgaaacgattgtgaagccggcggcaaaagcaatggtgaaagaggggcgctccttcacgggcgtgctgtacgcggggctgattctgacggaagacggatcaaaagtcattgaattcaacgcgcgcttcggagatccggaaacacaggtcgtcgtgccgagaatggaatctgacctcattcaggtgctcttagatcttctgcatgagaaggatgttgacctgagatggaaggacacggccgcggtcagcgttgtgctggcttcagaaggctatccggaaggctatgcgaaagggacgccgatcggcagtttgacgtccgctgaagacgggatcgccgtttttcatgccggaacgaaaaaagacggcggacaatttgttacaaacggcggccgggtcgccaatgtcacggcatttgctgaaacatttgaagcggcgagggataaagtgtacagcgccgtttcagggctgacaaaacccggactgttttacagaagcgatatcggcgcccgtgcgctgaaagcatcgcagcgataaagaggaaacccccgcgtcttaaaagatgcgggttttcttctgaatgacgactaagattgtcgatttgccgtgagagatggttcttctcggaatcgtgataacaggagaaaataaaataacaagccgaaacggcttgttatttttcttgctgatggctgtcatcctgattcattcctgtctggaacatatatgtcaccggacagaagcggaggatgccggacgccgctttcatcgcgcccatcatcatacagaagagatgcatcttgcaccaaggttttctcgtgtatttcgctgaagcggcagacaaaatggtgaggccgcaagtgatgcgcataacggcatttaataaactgatattcggtttcatcatttcagctcccttagaaaaagtttttcattcatcttcaataatttgtaacgttttagccgtgcgataattgtgcggatgtgatacgatgggtctaatataagcgaaggagagtatgtgaatgtccgaacgtacctttaactggaaaaataaagacatcagatcacaggcggatgttgtagactcaaagctgcttccaacgctacttttacgggatgctctcgtattaaatccttttttaaaacaatggctgaaaaagaacgtctggatttacggagaccgaattgtatatgttggtcatgagcttcctgatgcagcagagtacattcataccataaattgtgaaggaaaatacattgtgccaggttacattgaaccgcatacacatccttttcaaatatataatccccaaacgctcgccgaatatgtgtctcaattcggaacaacgacgtttgttaatgataacttgttttttcttttgcacagcggtaaaaagaaagcgcttactatattggaagaactaaaaaaacagccggtgcaatatttctggtggtccagatatgatctgcagactgaagtgctgaatgaggaccagctcctttcttttgatgtccgcaagcaatggattgagcatccggatgtcattcaaggcggagaattgaccggatggccgcgcctcatggacggcgatgacttgatgcttcattgcatgcaggcgacaaagaaactgcgcaagcggatagaagggcattttcccggagcctctgaaaaaacactgacgaagatgaaactgttcggggctgattctgaccacgaggcgatgaatggcgatgaggtgatgagacggcttgaattgggttactatgtttcgctcagacattcatccatccgccctgatttgagaacgattttgcaggatctccatcaaaaaggcttccggcattatgatcatttcttttacacgacggatggagcgacgccgcatttttataaaggcggcatgacgaatgaattaatcaaaatcgctttggaggaaggggttccggcgattgacgcctacaatatggcctcctttaatatcgcgaaatattatcagatggatgactttctcggtgtgatcggtccgggccggcttgcttcattgaacattctcgatgacccgatgaatccggacccggtcacggtgatctccaaaggcatcctgctgagggaagacggccgaaatatgaaggcgtttacagaaacggattggaaaaagggcggtcttgtccctcttgagctttcatatgatatgacgatggatgatttacagttttcaatgccgatgggtgtgataatgcgcaacgccgtcattatggagccgtatatgattgcgattgataattctgttgaccagctttcttttgatcatgatgaatgctatctcacgcttctcgataagcatggaaaatggcgggtcaatacaatgctgaaaggttttgccgatcgggtgcagggctttgtcagttcctacacgacaaccggagatattatcgctgccggaaaaaataaagaagatatcctgctcgctttctcacggatgaaagaaatcggcggcggaatcgtgcttgccgaaaacgggaagattctgcatgagatccccctcgccttaaacggttctgcatccgcggagaattatgaagaagtgcttgagaaagagcaaaaactgaggacgttgctggaggagcggggctaccgattctgcgatccgatctatacgctgctctttttgcagagcacacacctgccttatatccgcattacgccgagaggaatattcgacgtgatgaaaaaaactgtactctttccatcgataatgcgttaaaatataaaagcagggagccgacatatgaaaagatggaaaaccgtttgtatgctttgttttgcgtttttgctgcttgccgcctgccggcagaacaatgccgatcaggtgcagccgaaagaagcggaagctcctttaacggggctgaaaactgagcagaagcttgcagaacgccgtccgattgcagtcgcagtgaacaatcatccgaaggcgaggccccaatccgggctgtcaaaggcggatgttgtcatcgaagcgctcgcggagggccggattacgcggtttctcgcgatttttcaaagtgagatgccggaaacggtcgggcctgtgcggagcgcgagggaatattttgtcacgctcagcagcgggtttaacagcatatttgtccatcatggctggagtcccggcgctaaaaagcagctggagtccggaacttacgattatataaacggtttggattttgacggcagcctgttttggagagccgatttcagcaagccgccccacaattcctacacgtcgtatgacaatatcaggaaggcggcggaacaaaaaggatacaagctgaacggaaaaacagaaccgctcccatttcagacatcagatgcaaaacccggaaacgaaacctacaatattcggatagattatggaacacaaaacgttacaaatcttgtcgaatacgattatgataaaaaagctgatgcttatacaagaagctctgatggtgtgaaagcgacagaccggaagaccggaaagcctttagccatgcacaacatttttattgttgaagccggccatcgcatgacagacaaagatggaaggcgggccatcgatattcagtcaggggggaagggcctcctgcttcagcacggcgatgttatagagtcagactgggaatataaagacggccgtattctgcccgtaaaaggcggtgagattcttccgtttgtgccaggaaagacatggattaatatcgtgcctgatctcgatgcagcttccattagtaaaggagaaggtgtttgacgatgcaaatcgataaattacgcggaaaagaactggaccagttatttttatctattttatcgctgaaagatctggaggaatgctatcgtttctttgacgatctttgtacgattaatgaaatccaatcgctggcgcagcgtttggaagtggcgagaatgctccgcgaaggaaatacgtatcacaaaattgaaagcgaaacgggtgcttccacagcgacgatttcccgggtgaagcgctgcttaaattacgggaacgacgcctatgaaatggcgcttgaccgcgtaaacaaaggagaatcctcctcagctacgtaaaaaaccgctctgccgatgacggcaggcggtttttttatgcgtgctgattcaaaaggccggaaagttccctcaggcttccgtcttcctcccggtatacgatgtgttcagctgagaaatgaatcggcgagctgatacccgccgccgcggcaaggtgaaacagcccttcacgcaacgagagcacgtagttgcagacgcggtgctgtttatcctcgatactgagcgcgcgctgaagttttggatcggttgtcgctactccgacaggacaatgattggtgtggcatacttgagcgcggatacagccgactgaaaacatcattccccgggcaatattgacaaaatccgcgcctaacgcgagggcaacggcaatcttatccggagtgagcagctttccggatgcgaaaattttcagcttatctcttataccgtatgtcttcaaaaggccgtcaacaagggggaggccggtcagaatcggcaggccgacggaatccgccagttcatggaaagaagctcccgttcccccttcactgccgtcaatcgtaataaagtcgggaagtttgcctgatgaactcatacaggaaataaggtcttcaaggtctttgcggctgcccgggacaattttgatgccgaccggtttttcaccgacagttcttaatttctcaatgaaatcaagcatgtccggaacatttgagaattcgttgaagcggtttgggctgtcaatggattgtccgggctgcacatttctgatggcggcaatttcttcggtcacctttgaaccgtcaatatgaccgcctcttgctttcgccccttgcgcaagctttaattcaaaggctttaatctgctcgaggcggctttttttcttaaattcttcccatgaaaattctccatcttcagtgcgcacgccgaacagcccggggccgatttggcagataatatccgcgccgcctttcaagtgatactcagacaggccgccttcgcctgtattcatccatgtgccgccggcctggtgcagcccttttgacagggcggtgattgcccggtcgccaagtgagccgtagctcatcgctgattgtccgattaacccttttacataaaacggtttcttgcatgtgtcgcggccgatcacttgcacatcgtccggatgcaggtaataagggtccgcttttgctttttcacggtgttcgctgcgtttcagcaggttgtctttgtcaatcttgtataccatcgtgtcgatcttcggcgtctgatctgtgcgcagctcctccctttgtttcgggaagagggcgttacggatataatagcccggctgatcgaaatcccgttctgagccgaagcccatcattctgcttttatactttcccgacatgaccgtctgttcatattctctccgggaaaacggctgttcttcgttatcattgctgaataaatactgccgcagctcaggtccgattttttcaaatatatagcgcagttttcccgctgcgggataattgcgcagcactgaatgttcttcctgcttttcgtctcttatgtatatccagagaaacaatgcggcgggaactaaaataataaaaatcaatatacaaatcagtacgataatggcttgttccattgagaccagactccttgccttttttctctttgacattccacatattgtctgttttcaaacatagacgtttcccatcgggcggagcgcaatctttttttgtgaatcaggtgaatgacgtctttttccgtttttccgggccaaacgaatttgttataatgtttaaatggcaagaaacgaatggaggaacgaaaacgcatgtacgatgttaacgagtggaagcatgtttttaaactcgatccgaataaagatttaccggatgaacagctggaacggctttgtgaatcagggactgacgccattgtgatcggaggaagcgacaatatcaccgaggacaatgtgctgagactgatgtcaaaggtgcggcggtttttagtgccgtgcgtacttgaggtgtcgacgattgattccattgtgcccgggtttgatctttatttcattccgagtgtgctcaacagcaaaaaggcggactggattgtcggcatgcatcatcaggcgatgaaagaatacggagagctcatgtcaatggaggaaatcgtgacggagggctactgcatcgtcaaccctgattgtaaggcggccgctttgacggaggcggatacacatatagaaacagaagatattctcgcctatgcgcgggtcgcggaacatttgcttcatctcccgattttttatctggaatacagcgggatgctggcggacatagaaacggtggagaaaacgaaggctgtgctggacaagtccgtcctgttttacggaggcgggattaaagacgcggaaacggcggaacggttcggccgtcatgccgatgtcatcgttgtcggaaatgccgtatatgaagattttgatcaggcgctcaaaacggtggcggctgtaaagacaaagtagccaagcgaacgaaattgatttatgatagaacatatgtttgataggcggtgaacggatatgaattacattagcaatcaattattaagcggattaaatcccgttcagcaggaagcggtcaagacgacggacggtccgctgcttctgatggcgggcgcgggaagcggaaaaacacgtgtgctgacgcacagaatcgcatacttaatggcggaaaaacacgtggcgccatggaacattctggcgattacctttacaaataaagccgccagagaaatgaaggagcgggtggagagcattctcggacccggcgcggatgaaatctggatttccaccttccacagcatgtgcgtgcggattctgcgcagggatattgacagaatcggcatcaaccgaaacttttccattcttgatacggctgatcagctttccgttattaaagggattttgaaagagcggaatatcgatccgaaaaagtttgatccgagaagtattttaggctccatcagcagcgccaaaaacgagctgatcgaacctgaggaattcgcaaaaacggccggcggctactacgatcaggtcacgagtgacgtgtataccgattatcagaaaaaactgttgaaaaaccaatcgctcgattttgatgatttaatcatgacgacgattaagcttttcgatcgtgtgccggaagtgcttgagttttatcagcgcaaattccagtacattcacgtagacgagtaccaggatacgaacagggcgcaatacctgcttgtgaagcagcttgcggcccgccttgaaaatatctgcgtcgtcggtgactccgaccagtccatttacagatggcgcggggcggatatcgcgaatatcctttcctttgaaaaagattatccgagcgcaaacgtgattctgctcgagcaaaactaccgctcaacaaagcggattctgcaagcggctaacgaagtgatcaaaaacaactcaaaccgcaagccgaaaaacctgtggacggaaaatgacgaaggcatcaagctttcttattacagcggcgacaatgaattcggcgaaggccaattcgtcgcgggcaaaatttatgagctgcacagctcggggcggcggaagctttccgatatcgcgattttataccggacaaacgcccagtcgcgcgtcattgaggaaacccttttaaaatccggtctgaactacaatatcgtcggcggaaccaagttctacgacaggaaagaaattaaagacattcttgcatatctgcgccttgtgtcaaatccggacgacgacatcagttttacacggatcgtcaatgtgccgaagcggggcgtcggcgccacttcgctagaaaaaatcgcgtcatatgcggcgatgaacggaatgtcaatgttccaggcgatcaaacaggttgatttcatcggcgtcagcgcaaaagcggcaaacgcgcttgacggctttggcgcgatgattgaaaatctgacgaacatgcaggattacctgtccattacggaactcacggaagaaattctcgaaaaaacagaatacagagaaatgctgaaggctgaaaaatcaatcgaagcccaaagccgccttgaaaatatcgacgagtttctttccgtgacgaaaaacttcgaacaaaaaagcgaagacaagtctctcgtcgcgtttctgaccgatctggcgctgatcgcggatattgaccagctcgaccagaaggaagaagaagcaggcggaaaggatgccgtcactttaatgacactgcacgccgctaaggggcttgaatttccagtcgtgttcttaatgggcatggaagaaggcgtgttcccgcacagccgctccctgatggaagaagccgagatggaagaagaacgcaggctcgcatatgtaggcattacgagggcggaagaagaactgtatttaacgaatgccaaaatgcgaaccttattcggccgcaccaatatgaatccggaatcccgctttatcagggaaatacctggcgatttattggagaacctaaatgagaagaaaacacctcgcatgcagccgggacgaaaagtgcagccgaaacgcgggcccgtatcccgtcctgtttcctatgcgaacaaaacaggcggcgactcgctcagctgggcggtcggcgataaagcgggccataaaaaatggggcaccggaacggttgtcagcgtaaaaggagaaggcgagagcaccgagcttgatatcgcattcccgagcccagtcggcgtgaagcgtctgcttgcagcttttgcgccgattgaaaagcagtaacctgaagaggaaaggaagaacatgatggacaaagaaacagcgaaacaccgggcaaaagaattgcgccgcaccatcgatcagtacagttatgaatattacaccttagatgaaccgagcgtgccggattccgagtacgacagactgatgcaggagctgattgccatagaggaagagcacccggagctcagaacgcctgattcgcccacacagcgggtcgggggagcggtgcttgaatcttttcaaaaggtgcagcacggcacgccgatgctcagtctcggcaacgcatttaacgatgatgatctccgcgattttgaccgccgcgtccgtcaggctgtcggtgacggcgtcgcttacaatgtggagctgaaaatagacggtcttgctgtttctctccgttatgaagacggctatttcgtcagaggcgcgacaagaggagacggaacgacgggcgaagatatcacggaaaacttaaaaacgatccgcaacattccgctgaaaatgaaacggaatctttccatagaagtgcgcggagaggcgtacatgccgaaacagtcatttgaagcgctcaatgaagaaaggctgaaacatgaagaggagccgttcgccaatccccggaacgcggctgcgggctcactcagacagctcgatccgaaaattgcagcgaaacgaaatcttgacatcttcgtctacagtatagcggagcttgacgaaatgggtgtggaaacacagagtcagggcctggattttctggatgagctcggttttaaaacaaaccaggaacggaaaaaatgcgccacgatagatgaagtcattgaaatgatcgaagagctgcaggcgaagcgggccgatctcccttatgaaattgacggaatcgtcatcaaagtcgattcgctcgaccagcaggaagaactcgggtatacggcaaaaagcccgcgctgggcgattgcttacaaattcccggcggaagaggtcgtgacaaaactgctcgatatcgaactgaatgtcggaagaacgggcgttattacgccgaccgccgttctggaaccggtaaaagtcgcgggaacgacggtctcaagagcatcccttcataacgaagatttaattaaagagaaggatatccgcattctcgataaagtggtcgtcaaaaaagcgggcgacatcatccctgaggtcgtcaatgtcttaattgaacagcggaccggggaagaaaaagaattcaatatgccgaccagctgccctgagtgcgaaagcgaacttgtccgcattgaaggggaagtcgcgctgcgctgcatcaatccggaatgtccggcgcagatcagagaaggcctgattcactttgtctcacgcaacgcgatgaatattgacggactcggagaacgtgtcatcacacagcttttccgtgaacatctcgtccgtaatgtcgctgatttgtataagctgacgaaagaacaggttatccggcttgagcggatgggggaaaaatcaactgataatctgatcagctccatccaaaagtcgaaagagaattcgctggaacgcctgctgttcggtctcggcatccgttttatcggctcaaaagcggccaaaacactggccatgcattttgaaagcctggaaaatctgaaacaagccacggaagaagagctgcttgcggtagatgaaatcggcgaaaagatggccgatgccgttgtcacctatttccgcaaagaggaaatgcttgagcttttgaatgaacttgaggaactcggtgtgaacacactctacaaaggcccgaaaaaagtaaaagcggaggacagcgactcttattttgccggcaaaaccatcgtgttaaccggaaagcttgaagagctgtccagaaatgaagccaaggcgcagattgaagcgctcggcggaaagctgacgggatctgtcagcaaaaaaacagacttgctgattgccggagaagcggccggaagcaagctgacaaaagcgcaggaattaaacattgaagtatggaatgaagcacagctattgggagagctaaagaaataagaggagtgttttctattgaaaaagatgttggcattggcggcgacggcaacggcggcagtactcatgctgtcggcctgttcgccgagtttcgggggaaaaaaagaggaagagatcacgcagaaaacggcaaagtcttctgaaaaagcgatcataccgaaatataatatctctgattcctactataaaatggtgctcccgtttaaggccggaaaagcgcgcggcctgaccgcggaccggctgaacacgaggctggacatcgatgaattcgagacggggctgatgcggctcgctcaagacacgttcccgacggatgactatttgtatcaggaaggccagtatttagatgaggacacggtactcagctggcttgaccgcaaaaaagaaggcagtgatctgaaaaaggcgaaaaaggcagacgccaatttccagaatctcggcttaaacccggtactgccaagttcgggatcggcaaaagagaaaaacgaaaacagcccgatttacttagcgtccatgcttgagcaggattacttagtaagaaaagataaaaattccatccagcttggaggtgtcatgatcggtctcgctctcaactcagtatactattaccgcgaaaacacaggtgatccgcagcaggaagtggagctcagcgacaaaacgatccgcaaccacggtgaagaaatcgcacaggaagtcgttaaccgccttcggaaaatggataacctgaaaaatgtgccgattaccgtcgccctttataaacaagcgccgaaaacatcaatcgtaccggggaattacattgcgaaaacagaagtcaaggccggctcatccaccatttcaaactgggatgatgtcaaagaaaagtacgtcttctatccggcggatacagacacggcaaagaaataccctgatgattccgaagtgtttaaacgcttcaaaaacgccatcgacagctacttcccgaattacaccggagttgtcggaacggcaatgtacgaaaacgatgaaatgagaaaaatgaagattgaaatcccgatgcaattttacgggaaaagcgaagtcatcgcctttacccaatacttaacaggtgagctgatggattattattcaaaaggctcagttgatgtcgaaattaacattacctcgtctgacgggcaggaagcgctgatcgtccgcaatgcgggtgacaaagaaccgaccgtccatatttacgattaaccaagatgcccttgttcatttctgtatgagcaagggttttttagtgtgaatatcgttggagagaggaatgaggtatgttaagatatttgtataattaggaattaacaggaaaacatatttcatttctaagcggatgttacgaatctgctgtgaaaaaagaagggcaggaatgttgatgaatgacatttgctgagtacacacaccgcctacaaatgttatgaaaagggtgaatcagcatgcataaagatattaaagcgatttttgaggaagataaggtactggctgaggccggtgaaatatacggatttaccaagtttcaatttattgcggacgcagagaactacgtatatgaaattgtgaaagataacgaaccgtatatcttaaaaattacgcatacgatcagaagaacgccggaatatattctcggggaaatggaatggcttcatcatctggcaaagggagagctttcagtagcaaagccgattccttcattaaatggcaaagatgtcgaagaagtcccggatggaaaaggcggagcgtttttattaagagtctatgaaaaagcgcccggacgaaaagtggaggaatcagactggaacggaacgctgttttaccagcttggaaagtacacggggaacatgcaccggctgacaaaaagctaccgtctgagcgatccggcatataaaaggcaggaatgggatgaagaggagcagctgaagctgagaaaatacgtgcccgcagatcagcatctcgtatttgagcgggcggatgctctaatggaaaaactgcgccgtttgccgaagaatcctgaaaactacggccttgtgcacgccgatctgcatcatggcaattttaattgggacaacggaaaaatcactgcatttgattttgatgatatcggctacaattggtttgtgaatgatatcagtattctgctgtacaacatgttgtggtatccggtcatcccgtatgaagacaaggccgcgtttacgggtgaattcatgactcactttatgaaaggctacagggaagaaaatgaccttgattccgcatggtttgaacacatcccggatttcctccggctgcgccatatgctgatctacggattattgcatcaggcgtttgacctcaattcactcggggacgaggaactcgggatgctgaaagccttcaggcgcgatatcgaaaatgaaacaccgattacggagtatcaattttctgcattcgtataaatagaaaaacgccggctgaatccaacccggcgttttttataacgtatcacatttcactccgacgacgccctgaatttctttaatatcataatagacgtcagtggtgtagcggcttttatgaacactgactttcacttccataatcggaaattctttttcacccagatcatcaatccggacggagtgaatgcggagctgtttgcttttcatttcctttaaaatctcggtcattttgtctttatcggaaagagacattctcacgcggatatccttttccttcaagcggttgggaccgatttttctgatcagccacggaagaaattcgacactgatcaggataaacaagaggcttgcgaacgcctctttataaaagccggcacctgtagccagacccagcccggccgcgccccagatgatagccgatgtcgtcaggccggatatgacgtcattgcttttacgcaggatcacgcccgcgccgataaaaccgacgccggaaatgatttgggcgggaaggcggagcggatccatcatgatacggtaatattttgggaaatgatatgccgcattaatgctgacgatcgtcagcatacaggagctgacggcgatgacgatacaggttttcagtccgagcggtttgtttttcagttctcgttcaagaccgatgatcatgccgatcagcgtggcaatgcccagctttaataaaatgtctggttcgataggccagctcaatttgcacagcacctccgcaatttttcttataataaattgatatgattttctcacagtatttatagcaggacaagtgcggaagaaaaaagccgtcagggataaaatctgacggctttttgtctatttcttgtttttcaaaagagcttccatccggctgaacagctgataagaagcatcggccggttttttggtcagcaggctgacggcaataccggcaatcagactgaggaagaatcccggaatgatttcgtataccccggttgaagcggcaagccctgtcgtaatccagattaaaacggccgcggccccggtaatcatcgccgcaagcgctccccattcattcatccgtttccagtacagactgagcaagagcgccgggccgatagccgaaccgaagccagcccacgcatatccgaccagatcaagaatggtgctgttcggattcatggaaagcaggatggcgataacggccacgatcaataccgacaggcgtccggtcatgaccaattctttatcgctcgcttcccgtctgaaaaaggcgcggtataaatcttccgtaatggcgcttgccgttacgagaagctgtgaggaaatggaactcatgatcgccgctaaaatcgcagacagcaagaagcccgtaatcagcgggtggaacaagattttagaaaaaataatgaaaatcgtttccggatcttttacggagaccccgaagtgatgagaatacgcaaccccgataatcccggtcagcaatgaaccgacaactgaaataaccatccagctcatcccgattctgcgggcgggttttaaatctttcacttctttaatcgccataaatcgtacgatgatatgaggctggccgtaatagccgagtccccatgccaaataagaaataatgctaatgacgctcgcgcctttaaagatatccaatagtttcgggttaacggcgttgatcgaatcaatcgtcgttgaaacgctcccgagctgggtaaaagcaacgatcggcacaagcactaatgccgcaaacatgatcgctccctgtacaaagtcagtcagactgacagcgaggaaaccgccaaacagcgtgtaaaggacaacaacacccgccgttaaaaacaaaccgaatttgtagtcggcgccgaatgccgattcaaataacctgcctccggataccatcccggacgatgtgtacagtgtgaaaaagatcataataatcacggcggaaacaattttcagcaatgatgacgagtggcggaaccgtttatcgaaaaaatcgggaatcgtaatcgcatcatccgcaacttccgtgtaagcgcgcagcctcggagcaagcagcagataatttgaatacgcgccgatcgtcaaaccgagcgccagccataaggtcgataaccccgttgcgaacattgcgccgggaactcccatcagcatccatgcgctcatatccgccgcacctgcggacagcgccgttacgaacgggccgagtcctcttccgcccagcatgtaatcattaatattcgttgtcttcctgaatgcgtaccagccgattaacagcatggcagcaaagtaaatgccaagagatataattaattcaatactcacgtttttggaccctctcttctttcatgtaaatgttgcatcacctctgtagattagtagtgccggaatatgcgccggcgatccagcctttagtcatcattccatgcgaatcacatatttagtgccggctatggttactaaacctaacaaagtatccccgatcaatcaactctcgaaacctggcccgctcaaggaaaaaatccccgccaacatagaacagcttagagatgaaaacgctaccaataaattataaaagtaaaaattttctgacatataattcgtttctctttctccccgatttaggataaaatagagagggtttcatcatgcctcagaaggcggcgttttgttgctttagagggctcgtttttgatatgatcagtattatatgacgaaacggagaattatgcggaggtggatcttatgtcacgaatttctatagaagaagtaaagcatgtcgctcatttggcgagactcgccattacggatgaagaagctgaaatgttcacagaacagcttgacagcatcatctcgtttgccgaggagcttaatgaagtggacacggataacgtggaaccgacaacacacgtgctgaaaatgaaaaacgtaatgagagaagatgaagcgggtaaaggccttccggtcgaggatgtcatgaaaaatgctcccgatcataaagacggctatgtccgtgtgccatctattctggattaaaggagggagacagtatgtcattatttgatcacaaaatcacagaactgaaacaaatgatacataaaaaagaaatcaagatttccgatcttgttgatgaatcttacaaacggatcgcatccgtggatgataaggtgcaggcatttttacagcttgatgaagaaagagcccgcgcttacgcgaaagaacttgacgaagcggttgacggacggtctgaacacggtcttctcttcggaatgccgatcggcgtcaaagacaacatcgtgaccaaagggcttcgcacaacatgctcaagcaaaatcctcgaaaacttcgatccgatttacgatgcgacggttgtggagcgtcttcaagccgctgaagccgtcacgatcggaaagctgaatatggacgagttcgcgatgggttcttctactgaaaactccgcgtacaaagcgacgaaaaacccttggaatctcgatacggttcccggcggatcaagcggcggttccgcagctgcggttgcagctggcgaagtgccgttttcactcggatctgatacgggcggctccatccgtcagccggcttctttctgcggcgtcgtcggattaaagcctacatacggacgcgtgtcacgttacggattggtcgcttttgcgtcttcattagaccagatcggaccgatcacaagaaccgtagaagataacgcattcctgcttcaggcgatttcaggcccggacaaaatggactctacgagcgccaatgtcgaagtgccggactttctttcttcattaactggcgatattaaaggcttaaaaatcgccgtgccgaaagaatatctcggagaaggcgtcggcaaagaagcgaaagaatcggttttagccgctttaaaagtgcttgaagacctcggagcgacatgggaagaagtatctctgccgcacagcaaatacgcgcttgcgacgtattatctgctgtcttcttccgaagcgtctgcaaaccttgcgcgctttgacggcatccgctacggctaccgctcagacaatgcggacaacctgattgacctttataaacagacacgctcagaaggcttcggcaacgaagtgaagcgccgcatcatgctcggcaccttcgcgctcagctccggctactatgacgcgtattacaaaaaagcgcaaaaagtgcgcacgcttattaaaaaagattttgaagacgtatttgagaaatacgatgtcatcgtcggaccgacaacgccgacaccggcattcaaaatcggcgaaaaaaccagcgatccgctcacaatgtacgccaacgatattttaacgatccctgtcaacctcgcgggtgtgccgggaatcagcgtgccgtgcggatttgcggacggactgccgctcggactgcaaatcatcggaaaacacttcgatgaaggcactgtataccgcgtcgctcatgcttttgagcaggcaacagatcatcataaagcgaaacctgaactgtaaggggtgaaatgaagtgaactttgaaacggtaatcggacttgaagtccatgtggaattaaaaacaaaatctaaaattttctcaagctcaccgacgccattcggcgcggaagcgaatacccaaacgagcgtcatcgacctcggctatcccggcgtgctgcccgttttgaacaaagaagcggtcgaattcgcgatgaaagccgcaatggctttgaactgtgaaatcgcaacggatacgaagtttgaccggaaaaactatttctatccggacaacccgaaggcatatcaaatttctcaatttgacaagccgatcggcgaaaacggctggattgaaatcgaagtcggcggaaaaacgaaaaaaatcggcattacccgtcttcaccttgaagaagatgcgggaaaactgacgcatacgggcgacggctattccctcgttgacttcaaccgccagggcacgccgcttgtcgagattgtatctgagccggatatccgcacaccggaggaagcttacgcatatctcgaaaagctgaaatcaattatccaatacacaggtgtttccgactgtaaaatggaagaaggttcactgcgctgtgacgccaacatttccctccgtccgatcggccaggagaaattcggcacaaaaacggagctgaaaaacctgaactccttcgcgttcgtgcaaaaaggacttgagcatgaagaaaaacgccaagagcaggtgcttctgtcaggcggagtcattcagcaggagacgcgccgctacgatgaagcgacgaaaaaaaccattttgatgcgtgtcaaagaaggttcggacgactatcgttatttccctgagcctgaccttgtcgagctctgcattgatgacgaatggaaagaacgcgtaagagcaaccattcctgagcttccggacgagcgccgcaagcgttatatcgaagagctcggtctgccggcttatgacgcaatggttctgacgctgacgaaagaaatggctgatttcttcgaagaaacggtcaataaaggcgcggaagccaagcaggcatcaaactggctgatgggtgaagtctcagcttacctgaacgccgaacaaaaagagcttgcggatgtcgcactgactcctgaaggccttgccggcatgattaagctgattgaaaaaggaaccatctcgtccaaaatcgcgaagaaagtctttaaagaattaattgaaaaaggcggcgacgcagaaaaaatcgtcaaagaaaaaggccttgtgcagatttctgacgaaagcgtgcttctgaagctggtaacagatgcgcttgacagcaacccgcagtcaattgaagacttcaaaaacggaaaagaccgcgcgatcggcttccttgtcgggcagattatgaaagcctcaaaaggacaggccaacccgccgatggtcaacaaaatcttacttgaagaaatcaaaaaacgataaaaaaagcagccgtctgaaagggcgctgctgacacggagaccggtaagcgccggtctctttttttataagctgaaataggtttcaatggaagcccgcagcgtttcaatctgctcatttccgctgcctgccaagttggatagcattcctttaataatcggttttcgcggctcttcctttgcgtattcctcttcaatgacttcaagcgatacgaggacgtcctcaggcagcccctgctgtgcttttatcttttgaatatccgcaagcagtctttctctgtccgccgccggctgagtgaagatatcctcaggcagcagcggatcgggattgtctcttatcagtcccataatcaggtcatcgattctggcaatcagaaaggccgccacgttttccgtccggaatgccgtatgttcattaaaaatcaagaaatgaatataggagctcactattccttgcgccataacggacgcatccgctataaacggtatgacggcatctccgtaaacggagagcaaagcatcccggtacagcatgttaaattgaatattggcctcatgaaaatactgtttgaccttttgattttcaggaatgaccttttcgctcagcaagagaatgataaagtccttgtgctccataaattcctggaattgataagcgatttgttttcggaatacgtccttaggcgatttatgctgatgttctgttttgattttctttatttcttccatagacatgccgatgtaatactcacatgctgagagcaaaaggtcttcttttgatttaaaatgaagatagaaggccccttttgaaattccgcattcaccggcgatttcctgaatggttgttgaagaaaacccttttttggcaaataaatggatgcctgtttttatgattttctcttttttttcgttcatgacgtgcttccccttaatcctgaaaaatttagaaaaatttactgccttattagttgacgatgttgagttataccgtttagtattatatagaatgaccagtcagtcaataaaaattaacggaggacatgatgaaccacattattaactttgtactgaagaacaaattcgcagtttggctgatgacgattatcgttactgtagcagggctgtatgccggtatgaatatgaagcaggaatccataccggacgtcaacatgccttacctctcagtaaatacgacttatcccggagctgctccgagtcaagttgcggatgacgtgacaaaaccgatcgagcaggcggtgcagaatttagaaggagtgagcgtcgtaacgtccacatcctctgaaaacgtctcatcggttatgattgaatatgattacaacaaggatatggacaaggcgaaaaccgaagtcgctgaagcgctggacagtgtcagccttcctgatgacgcgaaaaaacctgacatttcccgttacagtctcaactctttcccgattttgacgctcagtgtgacaagcggcaaaagctcgcttgaagatctgactaaaaatgtggaaaacactctcgttcctaagcttgaaggcattcagggcgttgcgtccgtacaagtttccggacagcaggaagagcaggtggaattctctttcaaagataaaaaaatgaaagagtacggacttgatgaagataccgtcaagaaagtgatccaaggctctgacgtcaatacgccgcttgggttgtacacattcggcaacaaggaaaaatcagttgtcgttaacggaaatattacgtcaattaaagatctgaaagatatgagaattccggtcacatcttcttctgccgctcaaggtcaagcgggcggagccggtgcggcatctgcggcggacgctcaggctatgcagcaggcacagcaaagcgcgtcagcaggggtgccgacagtcaagctttctgacattgccgacattaaagatgtgaaaaaagctgaatccatttcccgcacgaacggaaaggacagcatcggaattaatatcgtaaaagccaatgacgccaacacggtagaagtggccgatgcgattaaagatgaactgaatcaatacaaaaaagaccataaagggttcaagtacagctcgactcttgatatggcagagccgattacagagtcagtggatacgatgttaagcaaagcgattttcggcgcgatttttgcggtcgtgatcattctcttattcttaagagatattaaatcaacgatgatttctatcgtttccatcccgctgtcactgctgattgcgcttcttgtgctgaatcagcttgatgtcacattgaacataatgacgctcggtgcgatgacggtcgccatcggacgggtagtcgacgactcgattgtcgtgatcgaaaacatttaccgccgcatgaggctgaaagatgaacctttacgcgggaagcaattggtgcgtgaagcgacgaaagaaatgtttaaaccgatcatgtcatcaacgatcgtaaccattgccgtattcctgccgcttgccatggtcggcggacagatcggtgaactgtttatgccgtttgccttaacaatcgtcttcgcgcttgccgcatcactgttgatttcgatcacactggtgccgatgcttgcgcacagcttattcaaaaaatcgctcacaggcgcacctgttaaagcgaaagagcataagccgggcagattggccaatttctataaaaaagtgctgaattggtcattaagccataaatggattacatctatcatcgcggttctgatgcttgtcggaagtttgttcctcgtacctctgatcggcgcgagctacctgcctgcgcaagcggacaaaacgatgcagctcacatacacgcctgaaccgggcgaaacgaaaagcgaagctgaaaaagctgcccaaaaagcggaagacatgctgcttaaacgcaaacatgtcgataccgttcagtattctttaggctcgcaaagtccgctcggcggaagttcaaacggcgcattgttctacgtgaaatacgaggatgacacgcctgattttgacaaagaaaaagacaatgtcttaaaagaaatcaaaaaaacatccagccgcggcgaatggaaatcacaaaatttcagttcgtcaggcaacaacaacgaattaacgtactatgtgtacggagattcagagtctgatattaaaggcacggtcaaagacatcgaaggcatcatgaaaaaggagaaggatctgaaagacgtcaactcaggcctttccagcacatatgatgagtacacgttcgtcgctgaccaggagaaactcagcaagcagggcctgacggcttcgcaaatctcccaagccctgatgtcccaaacgtcacagtctcctttgacaacggtgaaaaaagacggcaaagagcttgacgtcaacatcaaaacagaaaaagaccagtataagagtgtaaaagaattagaggataaaaccatcacatcgcctgcaggccaagaagtaaaaatcggcgatgtggcgaaagtgaaaaacggcacgacatccgataccatttccaaacgcgacggcaaagtgtacgctgacgtaacggcaaccgtcacttctgacaacgtcacgaaggtgtcatcagccgttcaaaagaaagttgacaaactggataagccggacaatgtatccattgataccggcggtgtatcagcggatattgcagattcctttacgaaactcggcttagcgatgcttgccgcaatcgccatcgtatacctcgttcttgtgatcacgttcggcggagcattagcgccgtttgcgattctgttctcgcttccgtttacagtcatcggcgcattagtcggactgtatgtatccggagagacggtcagtctgaatgccatgatcggtatgctgatgctgatcggaatcgtcgtcacaaacgcgattgtcttaattgaccgcgtcatccataaagaagcggaaggcctatcgacgagagaagcgctcctggaagccggctctacgagattgcgtccgattctgatgacggcgatcgcgacaatcggcgccctgcttccattggcattgggctttgaaggcggaagccaagtcatttctaaaggactcggtgtcaccgttatcggcggtttaatcagttcgactctgctgactcttctgattgtgccgatcgtatatgaagtattagcgaaattccgtaagaaaaaacctggaacggaagaagagtaagacagcgggccttggctccttaaacggagccggggccttttttcttctggcaattcctgtacatattgttgcgattttctcaagtcatagtataattaaaggttgttagtgttaataatggatcggatactcttaagtaggatgatgagataatgaaacgtgcacgcataatatacaatccgacttcaggacgggagctttttaagaaaaatcttgcccaggtcctgcaaaaatttgaacaagccggttatgaaacctccacccatgccaccacatgcgcgggggatgccacccacgccgcaaaagaagccgctttgcgggagtttgacctgattatcgcagccggcggagacggaacgattaatgaagtcgtcaacggtcttgcgccgttagacaaacgcccgacactcggcatcattccggtcggcacgacaaatgatttcgccagagcgctgggcattccgagagagaatatactgaatgccgctgataccgtcattaacggcgtggcccgcccgatcgacatcggacaggtgaatggtcagtattttatcaacatcgccggcggaggccgtctgacggagctgacgtacgatgtgccaagcaaactgaaaacgatgctcggccagcttgcttattatttaaagggaatggaaatgctgccttcacttcgaccgacagaagtcgagattgaatatgacggcaagctgtttcaaggcgaaattatgctgtttttagtgacgctgaccaactcggtcggcggattcgagaagctggcccctgattccagcctgaatgacggcatgtttgatttaattattttgaaaaaagccaatctcgcggagtttatcagagtcgcgagcatggcgctcagaggcgatcatattaacgatcagcacattatttacacaaaagcgaaccgtgtgaaagtcaatgtatcagaaaagatgcagctgaacctggacggcgaatacggcggcatgctgccgggcgaattcgtgaatctgtatcggcatattcacgtcatcatgccgaaggagaaagcggaacagctggatgactaatacgcggacaaaatcctaaaacagtattcgttttaggattttgtcatcttttcagcgtgatcggaaacctttgaaggctgacattgaatttgaaggtttgccagcacgctgaaacaaggcttttggtaaaacgagaggtgattatagatgaaaatgaaacccccgatagaaaaaaatgaatactatgacgtgacatttgaggatttgacgcatgaaggagcgggcgtcgcaaaggttcagggcttcccgatcttcgtgccgaacgccctgcctgacgaaaaagcgcaaatcaaagtgacacgcgtcaaaaaaggcttcgctttcggccgtttgatcgagctgaaggaagaaagcccgcacagaacggatgccccgtgtccgatctacaaacaatgcggcggctgccagcttcagcacatgacctatgaaggccagctcttgtttaaacagaaacaagtcaaagacgtcttagaacggatcggcaagctggacctctcaaaagtcaccgtgcacccgacgctcggcatggaagacccgtggaactacagaaacaaagcgcaggtgccggtaggagaaagagaaggcggactcgtcgccggattctatcagcaaagaagccatgacatcatcgacatgagcgcctgcctgattcagcaatccaaaaacgatgaagccgtccaagccgtcaaagacatctgtgcagcatacggtgtcaaagcctataacgaagaacgccacaaaggctggcttcgccacatcatggtcagatacggcgtcgtcacgggcgaaatgatgatcgtcttcatcacaagaacaagcgattttccgcacaaagcgaagatcatcaaagacattacggcgcaattcccgcacgtcaaatcgatcgtgcaaaacatcaacccaaataaaacaaacgtcatttttggggacgaaacaaacgtcatctggggcgaagaatacatctacgacctcatcggagacgtcaaattcgccatctccgccagatcgttctatcaggtcaacccggaacagacaaaagtgctctacgacaaagcgcttgagtacgcagagctgcaaggagaagaaaccgtcatcgacgcctactgcggcatcggtaccatttctctatttctggcgaagcaggcgaaaaaagtgtacggcgtcgaaatcgtgccggaagccatcgaggatgcgaaacgcaacgctgagctgaacggcatcacaaacgcggaattcgcagtcggagaagcggaaaccgtcattccaaattggtacgaagaaggcatcacggccgacaccctcgtcgtcgacccgccaagaaaaggctgcgacgaagccctcctgcggacgatcatcgacatgaaaccgaagcgggtggtgtatgtgtcctgcaatccaggcacgcttgcaagagacctgagggtgcttgaggatggcgggtatgcgacgctcgaagtgcagcctgtggatatgttcccgcatacgaatcatgtggagtgttgtgcattgctcgtaaaaaaatagaagatatataagggtccgagaatcggtaatggattctcggactcccatctgtttttgttgaagtaatcccttttctaattttaacttttccttatttagtttagcgagttggataccattatcctgaatgagcaatctgtattcttcttgttgggctttaccccgtatttttctgcaagtgcagccgttttgtctttctttatgttttctatctccttgagaatgttagtgggttgtttgtgatcccactgaattaagtttgtttgcagcctttttatcaatgtctttttgaatagattttgtagagagtgttgaaaacatttgctttatatcatttgaaattgcttcaatcagtccattttctcttacatgatgatctgaacattttgtatgaccatacttattttatgccccacaaatatatcccttacgattggctttatagtacattctcttactacaatcagcacaaggaggaaatatttgttagtgggtgttttttagcttattgtccgtttgcgttttctttcagagattaactgttgaacaacatgaaaatcatcttttgagataatagacttatgagtgttttcgatgacaacgtaatttgctggattaatctttttacgcttttcagttgttacactaattgaaatttccttttgttgaaccaatttgatcctctcaactataaaaggtagcacgataactggcagtgttgatggtgaaggtagatttggaaagtaaaaggtacggagaaaaattaaaagaggtgtttctcatgttggacaataatgtagttgaatgtataaaagaaatcacagaatcctcaaggaatggaaaacttgtcttttttgttggcgcgggagtttcaacactttcagattatcctcaatggtggaggttggtagataagtatcatgaagagctctatgggagtccaaagaaagaaaactattcttctgatgaatatcttcgaattcctcaaatattttataatgtcaaaggtgaaatgacatttgatggtatactaaaagatttttttcaggtagataagcctacgaacccgatacatgacaagatattagctatgaacccagcacatgtaattacaactaattatgataatttgattgatactgcatgttggaagagagggaaatattttagtgtaataagtgctgaagaagacgttgctaatgctacttcatcaagatatttactaaaggttcatggggattttagacggggctttaaaggggaaaatgtagttttaaaggaagatgactatctgaattatgatcagaattatcctcttatcagtaatctcatgaagacaataattgcaacgcataccattgtttttataggttatggtttaggagattataatattaatatgttgttaaattgggtaaaaaagttacaaaaggacagttttcataaaccgttttttattagaacagatccttcgcccattgaaattgagacttcaatctattacgaaaataaaggattacgaataattgatgcagctagtttggtagatagtaatgaatatgattatttagaacgttattcagcagtaatggatcttcttattgaatcaaaagaaaataaatttatcactaaagatgacgaagtaattgattatatatacggaaaaataagcccattatttgcccttcagtatattcgtaaaattgatctcaaacatgtctttgaatacgattattactttgaagtcaatggtactgttgttcggcacaagaataagggatttggttacatggagcgtttttttgaattaagagagagctgcaatgagagaagtaaactttccaaaaaacaatctgaaaggtttaatgctctttctaatttctttgagaagaatggagttatctgtatggcgaaagatgcaagtactctaaatatttcaatagagattaatagtttggcgtatcacggcaaatatgatgaaatgaagaaatttattgaagaacaatcggtaagtattgaggatgattataaaaaagcattttttcttgcgtgtttaggtaggtgggaggaatcctatgacctttattcaaaaatcatcttaaattctatagaagatgagccaaattggtgtgtatattatctatcacaaataaatagatataggatctatcaatcaataacacaagctgtaacgcagtttaatggttctggtttattaatattcgggaggaattataaaccatttactgatgattttcttgctaggatcgaaagagaaatgacaaattttagtatcggtgatttgtttaatggtatgtcatttgagtttcaaaagaaatataagatacttgagtttttaagtgataatcagtttttatatgatgatactgtaaaactttttgagttgactaataaagtgcgttctgaaatgagtaaaggatcttattcttttggaatgtcgtctgatattgttgttcttcttcggctttatgataatttacggtttttatatgaaaattgcttatggtctgtttcttttcatgaatttcatcaatatatgcgaaactcaatgagcctactaattgaaaaggctgaatatgagcgaacgagggatatagatgaattaggattctctttttttggaacaaaaacaggtttttttattgaatattacgattttgttaatatatcaagaaactttaaaattgatgacataaagaaccttgagagaagttgctcaattgataaaattaagtttggtgaacaggaaaaaatagaagaatacttagttggtatagcagaagaaattactaagcaattttctgctaatggaatgaacgtcgttttttatactcagtttatttcagaagcaaaagcagcactctattttgctaaatatgtaaaactatctgaagagggacttgggaaaatagtgaaagcattgttgttttattttcctgagagagatttggatataggaaaacgctatgtatggttagagaggttaactaaatttaatggtttacctaagtcaataatttcaattattgatgattttctagtgttacatgcagagaaacatattgatcaaaattattcagaggtatcatcaaatggtttatattccagggactatggtgctttaattaagcattttgagaagaatttcatttcaaaaagattatcagaaatcaccttatgtttaacacaagataagcaaaaacaatttgattttttgtttaaattattacccatactttccactaatgcaaaaagtcatctattaagttttaaaaaagttgaaaatataaatgatttaatgaatgggattagaataggcttaattgatgagttcactccggagtatgaagaattaattattgaatatctggagacacgaaaagcaaattatattgttgaaaaggggatacaaactttttcttctaacgactatatgagtacctttggtctatggtattttcttgaggaaataaataattcaaaaatggaagaatttatcggaatggatgatcagtatgacttttttgtagacccagagaactttgattacaaaaagtttataccttcgtggctaaaaaattataatgataaattacttggtaaaatcgctggaaataaacatatgaaacatcatgtgattgaggtactaaaagaaagagttaaaaactcaaatgataagaggtatttggaaattttaatgaaccactttatctaactcgttgtaaatctttactaaaggcgaattccactgctcaagaaaatttgctatgatttgtctacacctagctctctacgcatgtggagtgtgtggctggactggaacttagagaagggcagctaacctctttgtggggtgttgccttttttaaataaatttatatttaaatcactaatttctgatatatgccattcaagtgaggtcatcattttggggatctcaagcagaagtttatcaacatcttgaacattgttaggattagtgtgttcactcttcttgagaagtttgtccatggcggctaataatacagataagtcggttaggttgtcttgttgttctttgaattcttcaacaggcagtatatttgtttgaccattgttatttatcttttctaaaaggtttacaatttcttttaattggttaaactttgctttctcttatcttgttttttaagtcttttattttgtttcattcatagtggtagtgaaaatcataaactctgtccatcgattcaaaaaacgccagagtccctgttggtagagcaatgaaaaatgcttgtttaggcaatagattttatattatgtgtcaaggtgataaagcattaaatgtttgagattcttaaaggacgatctggaaaataggtttctcttttccactatttaaaacttcttccactatattcagtaaataggcctatagctgatcaactaggtcccgatatataaccatccaacatatactgattcctatatttgaattgaatggctccgtttatatagttgaaatcaagatcgggttttacttctcttagttcatggaaattatcaatttgtataaaatatgtatcggtcttattaggcaaatcagataaattggttatggttttgtttggtctacatatgagagtttgaatataaaacattctatcaccttgtcatcgtaaacttatgaaaaagagatgcagcctaagctgcgtcttatcctttttaaattccacttaaacataggaaactgcaccaataaatttaaatgaatagttttttgcagttatttctttctccctgccgtcatattcaaaattatataaaagaacagcagcattgatttgttcagggagtgcgatacctaccatgttttcgaaacgaggtaagatgacactatcgtatgaacagccgtcaattagtgcaggtaaattgttacgattattttcatgtgcaactttttctataaaatcctcatctaaatcatcgatatctatatcaaagtcaattaaaaattgtgaaggaagaaaatcaccttcatcttcattgtaaactaattcaacatatttacttaatgattcattatcctttatacttccaatccacaatgatacgtaattttggcgttccatataaacctcctattatttaatcctcaatccttttggcagggcttccactccacctttaagtctatagtttgcccaattattcaatctgcggacaaatatattatagtttagagaggaatcaataattcctagcaattcattatgggcagctgtagaacccaatcccccgtgtttaccaacaggatttacgaactcaacttcgtttatggcagttcttaaatctcttatttgttccgctgtaatattccaatgtttaaaggaaggagctcgggaaactaaatgccattcgtgcatgccgctgggtgctcttagttgtctttcaattgctcttctaacttttttatctgcccaaagttcattaagttgggaaagattaagaaacttatcagagactgtgcaaacataggaatagggtttccctgaatctataaagcctcaatattcttttcgattttttgaatgacttgtccgagccatagtattggggatagtccgtaactattgatatctacaccatctgcagactcgtctataaaattatttttttcttcatctgggtaatcgctatttataaacgttttgagtgctactacatcgttttcttgttcttttttaggtatctctgctaagtattcttctagagctgactcaggagtgtctatatcttgatggaaaatacctcctaaaaattgaaatgcaggttcagaaatatttgtttcaatcattgatttcacctcgtgggatagcctgttaatataaagctaccatcattattctttttcaatataattttagcattagttaagtcagaaatttcggctgagcctttggtaattcctctgcctaacacttctgatcctttataggagagaactaaaggttttttcacatcataattatttaaccattattctattttatctttattatttaataaagtaatattagcaaccttttctgcagttgctctatccttaaaagatgatgatccggatattttcttgttactcattttgcttttttcaagccttttcaggagttcttggtcagtcttaccaacatgtctttctataaggtgtccgccttttgcctcgtgagcagctaaacccccacccggtgcgagaggactgctgtctccttgtttaacactatgtatatcgctattgccagaattcacagattttctgagaacactctctttctgctcttcaataatacttttcaataaaggcgtattcttcacattgtgagtattttcaatatcctgtgctattccggcaagcgcgggttcgtacttgtttttcgaaaaggaattgatgtagttttgtcctttttcaatcccggtttttacatgttttgcagtcgctttttcaccggcttccaagacgttatccactttggcggcgcctgttttggcgagcttgtaggtcattgtcattacagccatcatatttaccgtcatatctattttcatatttaaaaaacaaaataaatgacctcttcagaccatacataacgatgtaacaggcagcacccgtttactggatgctgcctgttttgtttatcattattctcgaagccattacttaatatttagataatccttaacaaattccttgtcctcttcatcttcggggaagatacccaagttattgaactcccaaatcatttgtctttcgtattcgtccaaatcagactcaataacatcttcatagtcataatcaattgaaaacgttccagagctttcaagattcagtgtcaaatttgtccatgcttcaggattattttctttaaattcattgtgtaactgtttaaataactcttgaagatctaataatagttctgtataaatttctttactaacttgaaattgttctggaatgtcatgagagtatatatattcatcgttttcgggtgtttgaaagaaaaaatacacttctctggaaccgtctagtatttccgcataaagaacaactttgctccattcggaagggatcatatcattaatttgttcagcaatcttttgatatagcacttccatcttttttgtttccattagattaaccccctggtttattttctatagtaacttgtctcgctctacgattacctatcttatattcaacattaaataatacaggtcttagtgaatctccctgataaacgggttctatattaacttttacttgcttaggaggttttccgtttaatgcctttgaccacacttgctccattttataccatttcccgccgctcctattaatctgagaattcatcggcacgatgttgtcaaattggcctgagcctttgaattgggtggcgattaggtgacctccgtcgtcatctgtcagacggtctggtttacctgcttttgactgtgcatattggttgcgttttgcttctcccagctgtaagtctgctttgacacttgtaattctaccatagttgtcagtggtgtacgtgtagccttcttttgttttgtagatgacattcggcttcaatactttctttctggtccatttcgcaaaatgctcgccgtatttgaccgttaccggcggtacatgcggtgccggtgtccgtctgccgcttgcggaggttccgtacggtttcggcaggatgaccttggcgaatttctgcagtccctctttaagtgtgaccccgttgactgcgttgtaaggaacgcctgccggcactaagtcgtgacgcggatgataggggagaatatcagccagggtgagatctccaatttgatttaacttggttttgacacgtttttttgatacttccatgcctgtgtttactttttgtttgatgtgatcaacggtttgttttgagaccgttatcactttttgtgctgcggcggatttgcttgctgctgttttgactttggttgtcactttggcggctgtgcctgtttttgagacggctccgacgccttttgtgccgaggactgatgtcacaacggtgcccactgcatatgatacccatcttgctctggagtaggtgtcgccattcaccatgtctttttggtacgattcttcgattgccgctgaaatggcttcatacgttttgatcgggtgagccaccgctcctgtaatggcttcaaccgttccgcccggatctgtgaccatatcccataagcctgtgaccgcgtcttttccggaatcataaaggccgacggcaacgcctttgaatccgtctgtgagttcacgcgtgttttcaatttgagtgaagtagcgcttctgttcttttgtcaggtttttatagccgattgttttggccattgagtagaattcatcggcattcgcataatcgtagtttttcagtctttctttcagtttttcaatctctcgttctttcgcttcctctttcttcatcttcaaataagcatccgaatgtcttgcgatatcgccttttttcttatggatgtcgctttctcggtatgccttggcattgtagtgaagcggcgtggcgttttttcctttgcccgtagcgttttgaagctgttgaaagtcggcttggatgaactgttcgtttgcttcggtttctgcgtattcttttgttagatcgtgatcaagcttgccgagtttatgtatcgtttcgcttctttttttgtcagctgaagacagcttttgatctgtgctttcggttgaaaacagatcaagcgagatgatgtcttcgatctcaccgaggatggagcgcatgtcttttttctgctcttccataatcgcctttgatttactgagggcgtgggtgagctcatgctccaggaaagattcctccacatgcgaattggaaagtccggcgtcttcgaccttgccgggaaggcttgtgagaaatgcgattttcatatcgatcagatcaagccagctgtctgtgacgccggcgtggtccttgaaaaaagctttgatgttgtcggcgccccggcctgagaaatcgccgtcaccgaggtcagccatgccttgaaacgcttttttcaggttgaccatctgaccgcgcagttctttgtattcacccgcgcgctttttggcggcggccaggagggtggttgcttcgaaaactttcatgaccatatcctttcttttattcgatatcaaaattttaccacgtgagtcaggatatacagtgtaggaaataggtaataagaataaaatgaatcttttggcttgcgacttccttcctgtatgaagggggcttttttatgttttgtacaataatcctcaaattcggcttactgcgctccggtgattttaagcgtgcctgttttttctaatgtcttacactcgaaacaacccaaccgctgaggtataatagaagcagagtatttatcatacagattcaattcgtgaaagagagtggaacaaaatgggccgtaagtggaacaatattaaagaaaagaaagcatcaaaggacgcaaatacgagccggatttacgcgaagttcggccgtgagatttatgtggcggcaaaacaaggcgagccagatccggaatcgaaccaggcgttaaaagtggtgcttgagcgcgcaaagacgtacagtgtgccgaaaaatattattgagcgtgcgattgaaaaggcgaaaggcggcgcggaggagaactttgacgagctgcgttacgaaggtttcgggccgaacggttcaatgatcatcgttgatgcgttaacgaataatgtaaaccgcacggcgcctgaagtgcgcgccgcattcgggaaaaacggcggaaatatgggtgtgagcgggtctgtcgcttacatgtttgatgcgaccgccgttatcggcgttgaaggcaagacggcggatgaagcgctggaattgctgatggaagctgatgtggacgtgcgcgatattttggaagaggatgacagtgttatcgtatatgccgagcctgatcaattccatgccgtacaggaggcattcaaaaatgccggcgttgaagagttcacggttgcggagctgacgatgcttgcgcaaaatgaagtcgagcttccggaagatgcgaaagctcaatttgaaaagctgatcgatgtgctggaagacctcgaagacgtacaacaggtttatcacaatgtggatttaggcgaataaagacaaaaaggccgggacggcataagttccggcctttttattttgcttatgcggccggcctgtatcgtatttctccgtaagcaattattgattatttcaccaaaactgggcggatgcccatacgtttccttccgcatgtcataaactggactgtaacctatgtgaaggagcgataaatcatgaatgaaagaagaccgatttacggcggcggctatggaggctacggaggctacccggggtacggttttggcggctacggaggctacggtggctacggtggctacggcggcttcggaggatatccgggatacggtttcggcggaggctacggctacccgggatacggttttggcggttacggcggttttggcggctacggcggcttcggaggatatccggggtacggttttggcggctatggcggaggctacggcggctacccgttccatcatcatcatcatcgggacagccaatttatctgaccattcgggaaaagcactcttggaacagcaagagtgctcttctcatgttcttgcagctgtgttacgattggagcaaaatcatcaagtacataggacttttctgtaaatcatgagcaagttgtttataaactgaaaagcatgatctgtaaaaatctctttatcgggaggttttacatgtgagaagtgaagacgaaatgatgaaattgattcttgatattgcgatgaaggacgagagaatccgtcttgtcactttagagggatcaagaaccaataaaaatgtaccgagagacaaatttcaagactatgatatttcttattttgtgaccgatatggactctttcacatctgacgaaagctggctggatcagtttggcgaaagaatgatgatgcaaaaacctgaagatatggaacttttccctccggaactcggagactggttctcctatctcatgctttttaaagatcatcataaaatcgacttaactttgatccctctgagtcaaacagaggattattttacacagagtgatggtttggcggaaatagtattagacaaggatgaccgaatcaacagtaagatgattgcgagtgatgaacaatatcatataaagaaaccgacccccagagagtttgatgattgctgcaatgaattttggatggtttcaacctatgtgattaaaggattaatgcgtaaagaaatactgtttgcgctggatcatatgaatgacattttaaggcctaatgttttgcgtatgattgcgtggaatatcgggatagagcatcagttttcattaagtgtagggaagaattataagtatattcaacattacatgaatgcgaaagattgggaaattctgctgaatacttatgtcggcaatacgtatgaaagcgtgtggaaggcattgtttgactgccaggatctcttcagagcatattcaacgtcagtggctgttttattgagatatgaatatcctgaatatgatcagcaaattacggaatatacaattaaacattatcagcgctttcaatcagatttttcattatgattttttacttcaaattccagatgagctgcattgagtccgtttttaacgggctttttttattttcttacagggcataaatgccgatacggattcatacctattaaggtcatgtgtttaggaaaggaggatcgtaatgaaagaaaatcagccgtttacaccggtcaaatcctataaacccttccacagccggtttgatccctgcccgccgatcggaagaaaatactacagaacgccgccgcatctttatatgcggtttcagccgtatcacttggagcagttttctccgatggaggcattgagaaaaggaaccctttggaaggatctttacgatttctatgataatccttatcgggggggaatcgaatatggcgaaaaagattgatgatgaatactatcggctgctggagcaaattcaggcggcggactttgtcttggtggagctgacgctttatctggatacgcatccccatgaccgtctcgcgcttcagcagtttcatgaatattcccggtactcaagacagctgagaaagcggtttgagcctgagtacggaccgcttctgcaattcggcgtgagtcaggtcggcgctcaatgggactggggccgcggtccttggccatggcaagtataaggagggatctgtaaatgtgggtatatgaaaaaaagctgcagtatccggttaaagtgagtacatgcaacccgatgctggctaagtttctcattgaacaatacggcggggcggacggcgaattggccgcagcgctccggtacttaaaccagcgctacacgattcctgataaggtgatcggcctgctgacggatatcggcacggaggagtttgcgcatttagaaatgattgcgacgatgatttataagctgacaaaagatgcgacaccggagcagctgcgtgatgcagggctcagtgatcattacgtcaaccatgacagcgcgctgttttatcacaatgcggccggagttccgttcacagcgtcttacatacaggcgaagggagatccgattgctgatttatatgaggatattgcggctgaagaaaaggcgagagcgacgtatcaatggattattgatatttccgatgatcctgacctgaatgattcactccgttttctgcgtgagcgtgaaatcgttcactctatgcgtttcagggaagcggttgagattttaaaagaagaacgtgataagaagaaaattttttaaacggccctcaaacatgacggctgtttttttcctttctgcgtttggtctataataaaggtgtcaaatattctgattacaggaggattttatgacaccatttacgattacggaggagaaggcgggggcattccgggccacctccgcccggaaggatgatgaagaagaggttatggatctgctcgtgcaagcggcagaatggcttcgcgataaagggtcgaaccagtggaacggccttctgcaaggggaagatacccacaatatgcgggaggcgatcgccaaagggtatgtttttttattcaggcagaatgaagagctggccggcgtcgtcatgctgcttcccgaagcaagcgggtgggacagacgtctatggggcgatgaaggacatgaggagtccgtatatctccaccggctggcgattaacaggcggtttgcaggcgcggggctcggccggacaatcatgacttgggcggagacgggtgtgtcttgtccgggaaaaacgaaaatccggctcgactgcgtggccgaaaacaaggcgcttcagtcgttttacagcggaatgggttacgaatcaaaagggctcgcgccgggttatcatttgtttgaaaaaaaggtgagtaaataaaaagctccttatgacggaggtgcaaaagacatggggtttttttatctgatctgtctggccgcattttgtcttaactttgccgtatcggctgtgctccgtaagaaatggccgaaaaagatgtggcctgagtgccttttggcggtgctgggcctgactgctttcggtacggttgtttacagcattttcggtgtcggcggctgggaaggaatgggcttagggcttgccgcgatgtttgccggttccggagcggcagccggttatgccgctgaggtgtgcttacgggtcgtcagatcgaatcaaaaacagtaagcagaagtgaaaaaaacgcagcctcggctgcgtttttttgtgtattgccggccgctgtatagaaaacaggcggatgtccataatggtaatgacttttaagaagaaggtgcgaatatgggacatttacttacagtggcttgggagttagtatgcggcttgggtattttatttgtgattttaaaattgcttggaaaaacccaattctcgcaaattacgccgtttgattttatttccgcgctcatcctcggcgaactggtcggaaatgcggtgtatgataaaggcgtcaggattattgaaatcatttttgcttctctgttatggggggttttaatttatctcatcgaactgattacgcagaaagtaaaaagctccagaaagctgttggaaggcgagccgagtattatcatacataaaggaaaactgaaatatgatgtgctgaaaaagaataagctggacattaatcaattgcaaagccttctcagacaggcgaattgcttttccatacaggaagcggagtacgcgattttagaaacaaacgggatggtcagcgtcctgccgaaattccaatatgacacgacgaaaaacggcgacatgcaaataaagccgaagcaggtctctttgccggtcacgctgattattgacggcgaagtgctgtatgaaaatctgaaagaagccgggctggaagaaaagcagctgactcaggagctgaaaaagctgaacatcaaaagaacggaggacgtgctgtatgcggaatggaagcccgataaaccgctgtttgtcctgccgtatgaggagaaaaattaaaaagagcattgccctggggcaaatgctctttattatttttcgtgtacgcctgttttaacggctctgacatgatacataccgacatccgttccaagcatataatcaggtttcggcttgccttggtttgctttgtgggccgcgatgtggtcttcgcttttttcccattgtttccaatggtcttcagactcccagcggattaacacgacgacttcttcatcaccgcggcggacttttttttccagaaccgttacgtctatcaaaccttcctgcttttcaatcacgccttctgaactgaagcgttcgattactttgtcggcatgtccttcttttacggtcatttttctgatttgcacaaacatctggcagctctccaatccttttcacgttttatccaacattttaaatgaaaatgattctcaaagtcaattgagatgcctgacggattacgatttcaggagaaagacatgaccatcctcatctttaaattgcacgaagctgccccattccatttgtttcggttcatctaaaaaggtgatgccgttctttttcatctgttcgtatgcggcaaagacatcttcacactcaaatacgatagaagccttcatatgctcggcgcctttcatcatcgatttcggataaataaccaaatgagtggcggcccctttgggcgctacctcaagccagaaggcgcccggtcccatcggatgctcggcgacggtttcaaaccccgctttttccgtccagaatgttttcgctttttgctgatcatcagtgtatacggcaactgtcgcgatttttttgatcatcatactgacctcctgtttcatttcttttatagtgtgtcctcctgccgaaaaaagcaatcaaaagctttaatgtgccggctttttttaatttctctagtgcgattggcgattccgatttataatttagacaaaagtacatattcttgaaagaggagacggcagtgaacaaagaccaattacttcatgattatattattacacattcggcagagctgacggaaaaatggcttaagctgagacggaagctgagagggcgtttttattctgcggatcaattaagtgaggaaatgaaacggctgctgatcgagcagcatacctttacaaacacggtcatcgcaagcgcttttttggaagatccggccgtttttcagcataacaaagaaaaatgggccgcacaggtagcgaaaagcagagtggagcaagacgcggaggttcatgaggtcgttgaggcgatcggcaattcaagaaccgtcttttgggaggcggtcacccgttttatggatgagcatcaggacattgtaacaaatgaggatgcccgccgctggaattacattgtcaacggctcgtttgatcagctgatgacggattttactgaacagtttcagaaattaatgatcgcgaggctgtcatctcagcaggagcttatttccgaattgagctgtccggttattttgatcgcggatacgatcggcactctgccgcttatcggcgcgattgatacaagacgggcgcgtgtgattttggagtcggtgccggaaaactgtgtcgccaaacggatcacaaaccttgtgattgatctgtccggtgtgcccattgtcgatacgatggtggcgcagcaattgtatatgctgtcgaaaacgttatttctcctcggcatcagaaccgtgttttccggcattcggcctgatgtggcacagacttctatccaattgggacttgatttttcagagtatcaaacttacggctccctggagcaggcgctcgccagcatgggtgtcacatgtgtgatcgaggaagcaaaagcatagaaaaaaggtgctccggccagaggcggggcgctttttttgtcagcggaaaacaatttaaatattctaaaacttagttgacagctagggatagtttgaattattcttatacacatcgaaccggcacaaatagctgatcgtacacaaacgaaagctggccgttctgtccaaatctgataccggtataattgcccatcagtcaactgaaggcatattatttcccttttttgaaaggggataatatgcctttttttatgcggaaaaagagaggagaaatcaggcacatgaaaaaaacagcggcatttttagtattgatcttattggcaggggcgctgtcagcctgtcaatctgagtccggcagcgcgtcatcagacggaaagaccgttcagctgctgaatgtatcgtatgatccgacacgggagctgtataaagagtataatcaggccttttcttcctattggaaaaagaaaacgggtcaagatgtaaccgttcagcagtcgcacggaggttcggggaagcaggccagatccgtaatagacggactcgacgctgatgtcgtaacgcttgctttaggttatgacattgattcgatagcagaaaaagcccggctcattgatcaaaactggcagtcacgtctgccggatcaatcaactccttacacgtcaaccatcgtattcttagtcagaaaagggaatccgaaacacatcactgattgggctgacttggtgaaaaaggacgtttcggtcattacgcccaatccgaaaacatcgggcggagccagatggaactatttagcggcatgggcatatgccgatgaaacgtatcatcatgacgacacgaaaatcaaacagtttatgaaagacctctacggcaatgtggaagtgcttgattcaggggcgcgcggagccacgaccagttttacagaaagagggatgggggatgtgctgatcgcctgggaaaatgaggcctatctcacactgaaggaattcggcaaggagaaatatgagattgtcaatccttcaatcagcattctggctgagcctcctgtctctgttgtcgacaaaaccgccgataaaaaaggaacaaaaaaagcggctgaagcatatttgtcctacctctacagcaaaaaagggcaggagatcgccgcgaagaatttttaccggccccgcgataaagaggttctgaaaaagtatgaaaaacaattcccgcagattaaaacggtgacggtcgaaaaggaattcggcggctggaaaaaagcgcaggaaacccatttcaatgacggcggaacctttgacagcatctatgagaaatagaaagaggaaacgagtatgagaacgttacttttcaaaaaaacaaaaccgtccgtgattccggggttcggattaacgatgggatttacatttttatatatggccgttttggttatcgtgccgctgtccatggtgttttttcatacgatgtcaatggggcccggggacgtctggcatatcatttctgagccgagggccgcggcttcctatcggctgagcttcttgacggcgggctgcgccgctttgatcaatgcggttttcggcgttgtcatcgcctgggtgctgacgagatatgactttccggggaaaaggctggctgacggcctggttgatctgccgtttgcgctgccgaccgccgtcgcaggcattacattaacggcaatgtattcaccggacggctggatcggacagttgtttcctttccgtatttcctttacaccgatcggcattgtcatcgcattgacgtttatcgggctgccttttgtcgtcaggatggttcagcccgtcttagaaaatctccaaaaggaaacggaagaagcatctgcgtcacttggagcttcgaaatggaaaaccttccaaaaggtcattctgccggagctttttccttctattatatcgggtttcgcattatcttttgcccgcgccctcggggagtatggttctgttgtatttatcgcgggcaatatgccgtttaaaaccgagatttccccgctgatcattatgacgaaattagagcaatacgattatgccggggcaacagctgttgcggcagtcatgcttgtcatcacatttttcattttattcatcatcaatggattgcaatggctcaccgcgagaaaatacgcaggaaggtaggggatatgccatgcagctggaaacagcgaaaacagccgtgcctaagcgggagatacgggaatcacccgttgtgaaatgggtgctgatctcagcagttctgctctttttgtccatatttttaatcatgccgcttgcatttatatttattgaagcttttaaaaagggagcggaagcatatatcctctttgtcacgcatccggattcccttgccgcgatgaaattgacgctcctcgtcgttttcatcacggttccgctgaatacgctgttcggcgtcgccgcggcgtgggctgtgaccaaatatgaattcagggggaaaagtctgtttttgacactgattgatctgccgtttgccgtgtctccggtaatcgcgggcttaatctttgtccttttgttcgggcttcacggctggcttggtccatttttacttgatcaccagataaaaatcgtcttcgcagtcccgggaatcgtgcttgcatccttgtttgtgacgctccctttcattgcccgggaattaataccgcttatgcaaagcttgggaaatgctgaagaagaagcgtccgtcacccttggtgctggtggctggagaacgttctggcatgtgacgcttcctaatatcaaatgggggctgatctacggggtgattttgagcgcggcccgaacaatcggcgaattcggcgccgtatcagtcgtttccggtcatatcaggggtgttaccaacacgctcccgcttcatatcgaaattttgtacaacgaatatcagtttacggccgcttttgcggcggcctccgtcatgtcggtttttgcgattatgacactgtttttgaaaaacatcattgaatggaaagccggttatcgttctgtcaaagccggatgaggaaggagtcattatggagattacgatcgacactatttctaagcattacggaaactatcaggcattgcgggatatcaatcttcacgtcaataatggcgagctggttgcgcttctcggcccgtcaggctcaggcaaaacgtcattattgagagtcattgccggcctcgagcaggcagatgggggacgtgtcctgttcggaaaacaagatgtgacggatacgcatgtgaaaagcagacatgtcggttttgtgtttcagcactatgcgttattcagcaagatgacgatttttgaaaatgtcgcctacggattaaaagtccgtccgcgaaagcagcgtcccgccaaaaaggaaattgccgaaaaggtgagagagcttctggcgcttgtgaaactggaaccttatgaaaagcgctatcccccgcagctgtcaggcggacaaagacaaagagccgccctcgcacgcgccttggccgtagaaccgaacattctgctgttggatgaaccgttcggcgcgcttgacgccaaagtaagaaaagagttaaggcaatggctcagacggcttcatgatgaattcggcatgacaagtattttcgtcactcacgaccaggaagaagcgcttgatgtggccgaccgcatcgtcattatgaatgaaggtgcaattgaacagatcggaacgccgcaggaggtgtatgatcaccccgcaaatccgtttgtgtacgactttctcggcagtgtcaacgtatttgaaggaagagtggaggaaggaaagctgatcaccggaaacgcagcaatacctgtcgggcatgctgatcaggacaaggggatcgcttatgtgaggccgcaccattttaccgtagaaaaaaaaccgtccggtctgcattcatttgaagcaaaggcggctcatatccgtgccatcggaccgtccgtcagattggaagccgtccgtaccgacacaggccagcacttggagattgagctctcaaaagagcaatatgacgccttgggggcgggcgtcggcgacacggtttatgtcaaagcgaaggaagtgaaagttttcgcaaagaaaacatatccgaaaattgtgtaaatgctgttgatttctgaatgaaaacataatagtataattatatatttcttatcagaatagtatgaattaaaacactcattgtcaaaagacgaacggccagacataaagggggagcatgatgacgtccaaaggaaacgtagatccgcatgtgatcgaaaagattatcagtgcgctggaaacgctcgatttcgggactgttcagattacggttcataattcccaagtgacacaaattgataaggtggagaaatatcgattttccctgaagagcaaagaagtaaaacaatcttaaaaaacagccaatgacaggaggcggtacatatgaagcattcaactgttcctttccgggagagccggtatctgcacctgcccgaagtgcgctttctgcattggtgcacgaagcaatacggcataaataaaggcgtgctcaatacaattgacggctggttttatgatgcgggcgtcattccgattcccgtcaggcgtctttatgtgctggcattccttgatttcgtgaaaacgccggggcagaaggggaatatccgattcgggcacggcggattgacgaaaaaactgcatgatttcatggatatgcaggagtgcgcagcaaaacgtcaggcctgacatccttaaaatcttcttaagatcatgcaaatttctcccattttatttataatagacctatcacgatcattttttgggaggacttttgacatgcaaactgctgcttatgagagcaaacaatctattatgcagcgcattataacggtatttgtgtttacactgttagttgcgacaatcggcctgtatacgggccggttcattccgccggcattgatgctgccgctgtcggtcttagaggtcgtcatgatcatcgccgcattttggctgcgccgaaaaaaagccgtcggatatgtgtttgtcttttcattcgcttttatttccggaatgacgctgtttccgatcatcagccattatgcgtccgcagccggagcctatgtcgtattggaggcattcggttcttcgtttgtgatttttgcggtgctcggcacgatcggcgctaagacgaaaaaggacttgtcgtttttatggtccttcttgcttgtcgctcttatctcgcttctcgcagtggggatctttaatattttcagcccgctgaattccgccgccatgatggcgtattccgtcatcggaacgattgtgttttcaatgtacatcttatacgatctgaaccagatcaagcaccgggacatcacggctgacctgattcctttgatggcattgacgctttatatcgactttatcaacttgtttatcaacctgcttcggtttttcgggattttaaacagtgatgattaaccgcgcgaaaaaggcgccctgctgagaggggcgcctttttatgttctgtctccggaaaacagcagaagcttatcaaataaaacttcaagcatttttgtcaattccgctttttctccagcagtgaagctttccatgactgctgaaatgttggagaagtggccgggaagaaacagcatcagcttttcttttccttcccttgtaagttcgatgctgatttttcgtctgtcaccggtatgccggctgcggtttacaaagccgtcccgtgcgagtccgtcgatcaatccggtgatggtcgctttggtgacattggattttttcgccagctccgtcggactcaggctgtggccgggttcgtcaaacagaaacattaaaattttgaatttcccttcggacaatccgtgacttgagaaataatgctccatgacctgattcatttttttagacatatcaaataacgtcaaaaatgttttcaatgattcagcatccatatcggcgtaaatctcagcgcgtccggcaatctgcgagtaatccggcaaatgtctcaactccatttttgtaagcctccgtaccattttagtgattcaaagtataagcttgccggattcaaaaggcaacctataaagattgacagtttttcagcctatatagtaaggtgactaatagttaatgaatgataaataaatagagaaggcggtatcgtgatgaaccatgaagtgaaaaagatcatcatagcgggcggagggatcggcggcctgtccgcagcgatttctctcggcagagcaggttttgaagtaaccctttgcgaggcggcgtccgacatgcgaaaaagcggagcgggcattcttcagcctcaaaatgcgcttcgggtgcttcgggaaatcggtgtgtatgatgaatgctgtcaacacggctttcaaacggattggctgaagcagcatgatgaaaacggaacgctgcagtttaaagtgagtgaggcgtttttagatgatacattgccggggcggaataatatattgcggcaaacattaaacgatatcctcaggaagcatgctgaagcggcgggagtcacgattctgcccggtaaaaaagtcgtgtcttacgaagaaacggcagatgaaataacggtgcattgtggagacggaaccgcgatgacggctgacattctcgccggctttgacggcatccgctccgctgtccgcgatcaaatgctgcaaagggaagtgaaaacagagtatctcggcatgggagcgcacagattttacatttcttttcccgagccggtttttcatgattcaacactgatgtataaaaaagggcagacgcaggtcggggtcgtgccgctctctgaaaaaacaggatacgtatttatcatccggccgtatgacgctgacttcagggatgacgaggacacacgttttgaacgggtgagagacttgctgcgcggaattccgggagtaaagtttgtgacagagaatatgtcaagggaatatcccgttttgtttcataagattgagcagatggcggtcaaagaaccgtggcacagaggccgcgtcgttctgggcggggatgccgtccatgcaggagcgccgacattggcgcagggagcggcgatggcgattgaagacgcgattgtgcttagtgaagaactgcaaaagcacgaaaactatgaaactgcatgtcaatcatactttgaaagacgggcggagcgggcattacaggtgcagaatctctcatctgaaatcgtccgccgcgagataaagggaacgcccggcgtccaagacatcatcggtgaatgctatcgattgctcaaagagccttattaaataaagaaagtccagaacatggcgtctggacttttgtcagtcttgttcagatttattccgtatccgctcaatcacctcatgcagcccctcaggcttgtgaaactccaccggcgaactgcctttttcaaacgagatcgtctccgcctcaatgagcgcgacatagcgcccgttcacttttgcgagatggatggattcgccgaaatcagccagtaatcctttaatctctgtttctccgactttcattttcagctcggcttccggcgtgtgttcaatgatctgcgcggatgcctcgatgacttgatgggtgtcgaggcgctcctgaatttcccgcttttcactcgcttcccaaatttcaatgtcgtgctcaaactgctgaagctcttcgctgttttcttcaaaagtttcatacacgtgctcctgcaccatgttcatgacttggtttttcatgatttccggcatcgattcgccatattcgacaaatttgagaaaatcttcgaaataacgggcgtgcgaggcctggtggattttcagctcatgctcttccgtcatgccttcttccggcacatacggatattgaatgcttttcatgttttttgtcgtgatggccatttcgacctttttaatgagagacgaggcgtctgagatgcgggcgaccttcggctcgaaatcgcatttcatcataaagacgaatttgtcctcaaaatatttgcgcggaacggccgatgccacgataaaaacaccgccgcgcacggcgctcgtgtcaagataagtacggacgaactgctcgcttgcctcgataaatgcttccttcgtatccgcaagtctggcgcggttgaaaaggttgtaattcggatttgaatcaagctcatggcccggctccgtgataaaatggccgatttttgtggggacctgctcggattgcggatgccgttcggctttccgtttgacgattttcttcaattccccgtcaagaaaatccttcagctcgctttcttcaaattcttccgtgtcaagggtctggaaatgtttgaactgtttatttgcctgttcgtcttttccttccacttgaatgacataaaacgataaaaacttgatttcaaaatccatatgtgaactcaccttatttctgtatttgacaagcctctccagtatagaaaaaaccgttattgatcgtcaatccggggattgatccgtaacggcggataatcggccggtgaaaagggcactgtagttggaaggaacgcatcaatgtgtaagaaagggtgttattcatgaaggaaacaggtccgattccgcagccgaagacattcggtccgctcggcaatcttcctttgcttgataaagacaagcctacaatgtcgctgatcaaactggcaaacgagcaagggcctatttttcagctgcataccccggcgggcgccattatcgtcgtgtccggacatgaactggtgaaagaggtttgtgatgaagagcggttcgataaaagcattgaaggggctttggagaaagtccgggcgttttccggtgacgggctgtttacaagctggacgcatgagcctaactggcgaaaggcgcataatattctgatgccgaccttcagccagcgcgcgatgaaagattatcattcgatgatgactgatatcgcggtgcagctgattcaaaaatgggctaggctgaatccggatgaggccgttgatgtgcctgctgatatgacccgcctgacgcttgatacgatcgggctttgcggctttaactatcggtttaacagctattacagggaaacgcctcatccgtttatcaacagcatggtgcgcgcccttgatgaagcgatgcaccaaatgcagcgccttgatgttcaggataaactcatgatcaggacgaagcgccaatttcatcatgacattcaggcgatgttttcgttagtagacagtattatcgcagagcgccggtcaggcggacgggatgaaaaggatctgctggccagaatgctgaatgtggaagacccggaaacgggcgaaaaacttgatgatgaaaatatccggtttcaaatcatcacgtttttaattgccggccatgaaacgaccagcggcctgctttcctttgccatctactttctgctgaaacatccccgtgttttggaaaaagcctatgaagaagccgatcgggttttgaccgatcccgttccttcttataaacaagtactggagcttagttatatccgaatgattttgcaggagtcattgcgcttatggccgaccgcgcctgcgttcagcctttatgcgaaagaggatacggtgatcggcgggaaatatccgatcacgccgaaagacagaatttccgtcttaattccccagcttcaccgtgataaagacgcgtggggagacaatgcggaggaattttatccggagcggtttgaacatcctgatcaagtgcctcaccatgcgtacaagccgttcggaaacggtcagagggcgtgtatcggtatgcagttcgccctgcatgaagcaactcttgttctggggatgattctgcagcattttacctttatcgatcacaccgattatgagctcgatattaaacagacactgacgatcaagcccggcgactttcatatccgggtgcggccgagaaacaaaggagccgttgcggcagctctcccggcggctgaaaaagcggcggaagacgtcgaaaaagaaaaacgggaaacaaaaggcgcatccattatcgggcttgataaccgaccgcttctgattttgtacggctcagatacgggaaccgcagaaggcgtggcgcgggaacttgccgatactgccgggatgcacggcgtccggactgaaacggcgcctttaaatgaccggatcggaaaactgccgaaagaaggagcgctcttgatcattacgtcctcttataacggaaagcctccgagcaacgcgggacaattcgttcaatggcttgaagaagtcaaacgcggggaactggaaggcgtccgatatgccgtcttcggctgcggtgatcataactgggcggcgacatatcaggctgtgccgagactgattgatgagaagcttgccgaaaaaggggcggaacgcttttctgcccgaggcgaaggggacgtcagcggcgattttgaaggaaagcttgatgaatggaaaaaaagcatgtggacggacgccatgaaggcattcggtctcaagctgaatgaaaatgccgaaaaagagcgaagtgcgctgggtcttcaatttgtcagcgggcttggcgggtctcctttggcaaagacgtatgaagcggtttacgcatccgttgcggaaaacagggaacttcaggcgccggaaagcggccggagcacaaggcatatcgaaatcactctgccgaaagaggctgcctatcatgaaggggatcatctcggcgtgctgccggtaaacagcaaagagcaggtcagccgtgttctccgccggttccatctgaacgggaacgatcaagtgctgctcacggccagcggacagagcgcggctcatctcccgctcgatcggccggtcaggctgcatgatcttctgagcagctgtgtcgaattgcaggaagcggcatcaagggcccaaatccgggaaatggccgcttatacggtctgtccgccgcacaaacgggaattggaagattttcttgaggagggcgtctatcaggagcaaatcttaacatcgcgcgtctcgatgctcgatctccttgaaaaatatgaagcgtgtgaactgccgtttgagcgatttctggagcttttgcgcccgctgaagccgcggtattattcgatttcaagttcgccgcggaaacatcccgggcaggcctcaattaccgtcggtgtcgttcgcggccccgcccggagcggtttgggtgagtatcgcggagtcgcttcgaattatttagcggaccgcggccctgaggatggtatcgtaatgtttgtccgcactccggaaacacgattccggctgccggaagatccggaaaaaccgattattatggtcggtcccggcacaggagtcgccccgttccgcggatttctgcaggcccgcgcggcgttaaaaaaagaagggaaagagctgggggaggctcatctgtatttcggatgcagaaacgatcatgattttatttaccgtgatgagcttgaagcttatgaaaaagacggaatcgtgacgcttcatacggctttctcccgcaaagaaggcgtaccgaaaacgtatgtgcagcacttaatggcgaaagacgccggcgctttaatttccatcctcggccggggagggcacctctacgtatgcggcgacggcagcaaaatggcgcccgatgtagaggcaacgctgcaaaaagcgtatcagtcggtccacgaaacagacgaacggcaagcgcaagaatggcttttggacctccagacaaaaggcatttacgcaaaagatgtttgggcggggatttgaccgatgtgatgaaaaggactggatgactccggtcctttttcctttaataaaatgaattgctttccaatcgatatacattcggcttgtccaaccacacctggtcaagatatcttccctgcttgactcccggaccttctattttggtcatttctaaaacctgcaaaaattgtcatcagaagtgtggcttaaaagttttaccgtatgttcctccgttagccagaaattcagacagccattgcatgctatctattgagttgaagatcagcaggcttctcttttttattaggatgcttatataaaggacgtctcatgctgtaatggaagcataccggcgcaaagagtcccatctgctgttcccaagactaaatagttgcgcctattttggataaaacctctttacaaatatatggaattagaatatactctgtttcacaaagtactttgcgaaaagaggagcctgtcttatgtcaaatcagaattttcgtgaatcagagatagctgaaaacttatctcatatcaaagtcttgacgaattacaagactgagtactcaaggcaaaccagtccatatttcattatttggggctgtatatggattattgcgtattccgtttctttatttaaggtactttctgtagtccttgcttgtgtctggttaatactggcagtattaggatggatactgactttgaagacatatcttaagcagaaacaatttgatcctatgcccactttcttaaagaatcaattaaaatatgcttggattggattcatattagtggtatgcatttttgttttcctgtttttaatgggattattgccgcgaacaggagaatttctatcgtttttgattgttttaatggtgtctattatgtacatattcttaggcatcgtgttaacaaaagagatttttgttatgggattttggctgagcatactcggtatgcttacattctgcctatttcctgatgcaatgaatattgtttttgcatttattggcggaggcagcctattacttacaggaatgattttgaaaagaaaagggcaaggaaatgagtaatgttaacaatatcaatgatttaatacatgccaaagtgcggttgggaattatgagtttattgatgacttatgatcaatgtgattttactttcctgaaaaagtcattagacatcacagatgggaatttaggttcgcatctgaaaaagttagaagatgcagcttatatagaactaaccaagaagttcgtatccaaaaagccgaagactattgttcagatcacgaaagaagggaaagcagcctacaaggagtacattaatacgattgaatccatatttaaaataaataacagtgggggcatggtgtaaatgctgcaagttgaacatataagtaagcgctatggcacgactctggctttggacaatgttgctttaacaattccgaaaggagtctgctatggacttgttggaccgaacggatccggcaaatctaccttaattaagatcatctcgcgcatcatccgcgaatatgacggtaaggttgaatttgtcggcaaggaaaatggcaggctgggttatgttccgcaggatatcagccttgaagaaaaattaaccgcaaaaaccaatatggaatttttcggaaagttacacaggctgaatggcttaaaactaaagcaaacaacaaaaaaactgttagaagatatcgggttgttagaaagggcaaacgacgttgtggagaacttttctggaggaatgaagcgccgtttaaatatcgggtgtgcattaatgcacgatccagacttaattattctagatgagccgacggtaggtgtggacccgcaatcacgccgctacatttttaaaatcgtaaatcgactcaaaaaagccggtaaaaccattatttatgtgagtcattacatggaagagattgaaactctttgtgactatgtagcttttatcgacagagggcaaattatcgatgaaggagaaataaatgaactgcttaaacgacatgaagaatcatctattatgtttaactcctcattgtctcctgaattaataaagagccatggttttgagttttcagtcgttaattcagggttgataataaaaaccaaagaacctttagaaaccatggagcgcttaattagggtcagtaaggaaaacaatattgtgcctcatcagttgtttttatataagccaaaattagaagatgtattctttaaacttaccggcactgatttgcgtgatgaagaataaagggggaatttatcatgttaccgctcgctcaaattgaaacgctaaaacagttaaaggataagtctctgtttttttggacgattatattacccattgtgtccatcatattgctgattgagctatttacgacagacagtgcaaacaaaactttagtagcttctcaatctgtaaccggcatgagcgtattcttttcaacattcattattatctccatcgttataagttttgtaaaggatcgggaaaaaggaattgtatcaagactggcaagtactcctttaaagccttataacttcttcttaggaaaaagtatcccttttttagtcataacttttatgcaaattcttctcctttccgttctgggaatatttctgtacgatattgaaattaataattttccggcgtatttgtgggttgttgtgttgatatctttactagttacatcctggggagttgctatttcggtctttgcaaagactgaaaataccggcttggtcatgacaaatgtgattgcattaggtaccgctgttgtatgtggtttatggactccttatgatcaattgccaagctatcttcaaactattggaatgctcttccctcagtactgggcgcatcaagggttaattcaatcggtctcgacgatatcgggaggagaaagtctagtatgggtaacatttgttgtactgggctatacaatactaggatttatagtttctctaattggatacagacattacattaaaatggcgagaaattaaacctccgtgagaattaagatattaaaacgcagctgggactaaaaggagagcgggaaatgattagtgaaaaactaaaactgtatgtcgaggctcaatttaaaaagtatgaaaaaaactcgttgttgaacagaaaaaaaacggagctaattcctttattggcgggtttgatgaaaccagttcacaatttttttcgctaatgagaaacagaaatttgcaagacgccttaaggaccagtgttggagaacagtttaagcagtcacaaatgccagctctgctgcatggttggattataaaaaacaaaaggtatacgtgaagaaagcatttttgtatatctttagggtctaagcgataatttgacagggaaaggactggatgactccggtcctttttttacctcacaaaaaaaaccttcaagtttttcagtccctttgcatacaataacttcagcccgcctgttgggcggctgtctttgatattcatttttcgtttttagaagtttgtgttattcttatatttggtatctcctagtttcagaccgggtctgatacggtaccttttaatgccagaaaaaaatgtgaaacgaagaacggatatcctgcgtctaatggctggcgggataagatgttcaatgggcatgacacgaatgataaatatatcgttttttaaaatggtgtgtttatggggctgtgtgatgctttcgttttgctcggaaagcaggaattgaagcaaaaagtaagaatacagatttaaagtgtttaggaaagtagaggttgccatgaagaaattattttcttacagacttagtttttttgtactggctattattttgttttgggccaaaacgtatttagcctatcatgctgaattcaaccttggggtgaagggtccgacgcagcagtttctgcttgtgatcaatccgttctcaagcgccattttctttttaggactggcattgtttgcgaaaggccgcaaatcagcgattatcatggtgattattgatttcatcatgacgtttattttgtatgcaaatatcctattctatcgattcttcgatgatttcttgacattcccgaacttaaagcaatccggtaatgtcggaaatatgggagacggcatcttcagcattatgtccggccatgatattttatactttgttgatattattattttaatcgcgcttctggtgtggagacgtgagctgaaggaattcaagctgaaaaaacggtatacgtcattaattatcgtgacgggtattgtgttgttcttcgtgaacctggcgattgccgaagaggaccgcccggagctgctgacaagaacgtttgaccgcaattacattgtaaaatacttaggcctttataattacacgatttatgacggcgtacagacggcgcagacggaatcacagcgggcatatgccagcagcgatgacctgacgagcgttgaaaactacacatcgtcgcattatgcgaagccgaacgccgagtatttcggcaaggccaaaggcaaaaacatcattaagattcacctggagagcttccaatcgtttttgatcaattacaaacttgacggaaaagaagtcacgccgttcctgaataaactcgcccgcggcggagaggacatgacgtactttgataactttttccaccaaacgggccaaggtaaaacatctgacgccgagctgatgatggataacagtctgttcggactgcctgaagggtcagccttcgtgacaaaaggggaaaacacgtatcaatcgcttcctgccatccttgaccaaagtgagggctatacaagcgccgttttacacggtgactacaaatcattctggaaccgtgaccagatttacaaacatatcggctacgataaattctttgacgccagcacatacgatatgtctgatgacaaccttgtcaatatgggactgaaggataaaccattcttcaaagaatccataccgaagcttcaatcgctgaaacagccgttctacgcgcatctgctcacgctgacgaaccattatccgtttacgcttgatgaaaaagacgcaacgatcgaaaaagcgaaaacgggcgacgcgactgtggatgactatttccagacggcgcgttatctcgacgaagcgcttgaacagttctttaaagatttgaagtcatccggtttatatgacaactcggtgattatgctttatggagaccactacggaatctctgaaaaccataaccgcgcgatgaaagaaattctcggcaaagaaattacgccttatcaaaacgcgcagaatcagcgtgtgccgcttatgcttcgcatccccggcaaaaaaggcggggtgaaccatacgtacggcggtgaaatggacgttgtgccgacgatccttcacttggaaggcatcgattctaagaaatatattaatttcggcaccgatctcttctcgaaagaccatgatgatacggtgacgttccgtaacggagattacgtcacgccgaaatatacttccatctccaatgtcgtatacgatacgaagacaggaaaagaactgaaaggcaatcaggaaacgaaaaacctgaaagccagagtcacagagcagctgaagctgtctgacagcgtgatgtacaaagacttgctcagattccacaaattgagcgactttacgccggttgatccgtctaaatatcattacggcaaagaaaagctgaatcaggataataaataatagaaagagccttacggaatttccgtgaggctctttttttgtgtgtatcttcaccaatctgaaaaaagagagagcttttggtcacaaagggcgccaatctctcatatcttacagtagattttgaaaccggtgatagagaatcggacaaattatcgggttggtttctcttatacgggcggtttcgaatccaatattcacagagaagaggggtagagatgaaagcagtcattctctgcggcggaaaaggaacgagaatgagcgaaatcaccaatgaacgtcccaaaccgctcgccatgataggcggcaaaccgattctatggcatattatgaaactctatcaatactatggcgtgaacgaatttatcctgcttcttggtttcaaaggagagatgattaaggaatatttcttagattatgactggaagaatcacagcatgacgctggacagctctaccggagaagtgcggatattgggaacatccgagccgtggaaaatcacttttttagacacgggggaacacacgcagacagcggggcggcttttacaggcgaaggacatcatcggtgatgaaacctttcttatgacgtacggggacggactggcgaacatcaacctgtttcatctgatcagctatcatcaatcaaaaggggctgcggcgaccgtcaccggtatagaaaagacctcgcaattcggaacgctgacggttgaagacggtatggcgaaaagcttttctgaaaaaaactcaagtgacggcatcatcaacggcggatttttcgtgctcagcccgaaggtatttgattatctgccgaaagacagggacgtcatgtttgaagaagaaccgctgaaggagctggcaaaggacggcgaattggcggtataccggcattacggtttctggacggcgatcgatacgtataaaaacctgctggaaatcaacaagatgtgggaccggggacaacatgtatggaaggtatggtgatcaagtttgagtttctggaaaaataaaaatgtgtttgtgacgggatgtacaggtcttttaggaagcagcttggtgaaggaactgatcgatcagggggctaatgtgacggggcttgtccgtgacactgtgcccaagtcgaacctgtatcagggagaacaagtgaagcaaatgaatatcgtgcacggcgcgcttgaagatctggatgtgattgagcgggcgctgggcgaatatgaaattgacacagtctttcatttagccgctcaggcgatcgtcggcgtcgcaaaccgcaatccgatttccacatttgaagccaatattctcggcacatggaacatccttgaagcgtgccgcaggcatccgctcatcaaacgggtgatcgtcgcgtccagtgataaagcgtacggcgaccagccgacactgccgtacgatgaaaacatgcctcttcagggcaaacatccgtatgacgtatcaaaaagctgtgccgatttattaagccacacatattttaatacgtacggacttccggtctgtattacgcgctgcggcaacttgtacggcggcggggatttgaacttcaaccggattattccgcagacgattcagctcgtgctgaacggtgaagcgccggaaatccgcagcgacggcacatttatccgtgattatttttacatcgaggatgcggtcgaggcataccttttgctggcggaaaagatggaggagctcaatcttgcgggagaagcgttcaacttcagcaatgagattcagctgacggtgctggaacttgtagaaaaaattcttaaggcgatggacagtgacctcaagccgaaagtgctcaatcagggaagccacgaaatcaagcaccaatatttatcagcggaaaaggcgaggaagcttctgaattggacgcccgcgcataccattgatgaaggattggaaaaaacgatcgaatggtataaagccttttttcaaaagtaacagaaacagaggtgagagaaagacgtgacaagcgcatattgcacagttttatcaaaaggaaggctgtatcaggctatcgctttgttcggctcattgaaagcggttcaggcggacgcccccatttttactttgtgtatggatcaagacacctatgacgtgcttcaggcaatgcggccggataatgtcaccttgattcaggtgtccgcactggaaaatgaggagctccttgaactgaagcggacgagggatcagagcgaatactgctggacggtgaagccggtatttctcgaattcgtgctggacggacatccggaattagagcgtgtcacgtacattgatgccgatttgtttttcttcgctgatcctcgcgcgatttttgacaatcagccggattgttcggtgcttctgtcacggggcgatatcgtcattccctcatttgaaaaacaggaaatcgacatgctgcagcgtcttttaggccggtataattccggttttctcagcttcaaaaccgacagtgccggcacagattgtctcagatggtggaaagaacgctgcctggaagaatgcaaaaatgcgccgggcgaaggaaaattcggagatcaaggctacttggattacatgtccggcctgttcccgaatgtgtgtgacatcaccacgcccggcgtgaatatcggccattggaattacggccgccacacgttttcatggaaggacgggcgtcttgtgctcgaagacggaagtccgctgattttctatcatttcagcggataccggatcgtcacagccagcgacattcggcagattcatgagacggaccggaccgacctgccgtttgtccatcagctttatcaggacattctgaagcgggtgatcgggacggtcagcgccgtctgcccggagttcagcggctttgcatctgaggatgataacaaataaatgatcatatacaggaagtgaacgaaaagtgaaggcaagcgtcattgttcccgcatataattccaaggagaggctttataacagcctgctgtccctgaatgaacaggaatgcacagagccgttcgaagtgattgtggctgacaacggttcggaagacggaaccttatccatgcttgaatcattcagcgcgaattttccgctgatttttgtaagaattaaagaaaacagagggatcgcttacggccggaatcaggcggtccgcaatgccagaggcgatattttgattttccatgacagcgacatgcttgccgaaaaggatttggtggcgaagcatatcaaggctcatgagaaccgggacgatcttgtcgtatgcggtatgttctggaagcggatttacagcttttattatgaccgttttgaaaaagagcataaggaaaaactcgccgaactgtatgaagagctgccgggcgataaagaggcgctccttgatgaaagtgacatcagagacggaagctttcttgaccgatgctttgatttagataccgactttatccgggtgctgaaaagcattttggaaaaatacggagatgatttgaacggctaccgtctgccgtggcgttttttcattacgaacaattcatcagttaagaggcagcacgtggcagatctcggcctgtttgatgaaggcattgtcagatacggctttgaagattatgatctcggcatcaggcttcatcagtcgggaatgagatttcagctgcggcgcgatatcatgagcgtccatcaggagcatccgagcaactgcgcttccgttgatgacatcagggcgaatatcgcgtacatgtgcgacaagtacaatgacattcattcgcttgacgtgcacctcgcgtttaacggaccgtttgacgcggagttaaccaacagcatgatggcagatatcgaagtgctgcttgattatgagaaatatgaaagcctgctgcacatttttctcgagctgctgcacgcggttaaagaccgcaaccttgacccggactggaagacgaaaagcccgcggatcacggcgaacagcttccagctgccggaggtcggaaagcttttggcaaaagcggaaaaaaagctgggcgtcacgcactttgcaagggcgttcaaagcgctgactgctgatttactgcatgtggatcttaaataaattggatgtgatatggtgagtaaatatcatttttcaaccattgtttccagaacgcatatctttaaactgatgccgatgattcattctctccatgagcattgccgggattttcatctgtatgtgctgtgtgtcgatcagaaagcgtacgaactgcttcagcaggtgccgtgggaacatgtcacggcggttcagctccatgaaatggaggacccggagctgcttgaagcaaagggcggccggacgtttcatgaatattgctggacgctgaagccggcttttctgttccatgtgatgacggagtatgatgaagccgaatattttgcccatttggacaccgatctctttttcttctcagatgcgggcgagctgtttgcggaaaagccggatgcttccctttttctgacggatcaccgcaattcagaacggtttgcgtcttattacaagctgacggggcagtacaacaccgggtttgtcggcgcgcggaataccggggaagcgtatcgggcggtctggcagtggagacaggattgcatctcctattgtacggtggagatgaatgaagaaaaaaagacatacggtgaccaaaggtatgttgaaaagtggcccgcgcagtttgaacacgttcatgtcacggagtcgatcggcgcgaatgcggcgctgtggaatattgagcaatatgacgtcagcctgcgcgacggggctgtatatgtcaatgacaccccgctgattttttatcatttttcaggctttacgctcgtcacggagaacgaattcaatctctgctggtactatcacattgatgacgaggcgacagtcagtatgatttacgtcccgtacatcaaaaacgtaaaaaaatggattgatgaaattcaaaaagcgtttcctgatttcagagacgggtttattccgaaatatgcggttcctgacactcatttttatacggttgaaacataaaatccctgccttttcggcagggatttttttatgaatgccattcttttaatgttttgtcgctcggcaggacaaaggcgagcagacctaaaacgggcagaaaggcgacggctgtcatggtcggcgtcaatcccgctgaatcaataagagctccgagcgcaaccgctccgatcgcgcccattccgaaggcgagcccgaccgtaagccctgacatcgttccgattttgccgggaacaagctcctgcgcgtagacaaccgtcacggagaagctggacatcagaacaacgccgatcagcgccagtacgccataggcgatgacaggtcccgcaaacggaaggaaaatcgtcaagggagccgatgccgtcatggaaacgatgatgacgttccgctttccgaaacggtctgcaagcggcccgccgagaaacgttccgacagctccgaaaaataaaaagacgaagatgtagctctgtgcctgctgaatgctgacatgataggcattcatcgcatagaacgtataaaagttgccgatcgcgctcacataccaggagcgcgcgaaaattaagaagataatcatgataagggcgagaataatcggttttgtaatgacggtctgcacagcggcggccggtgattttttacttacggcgcgcaaatgaatcaggcggcctttataccatttggcgatataaatgagaaacagcacagcgattgcggcgacaagcgtaaaccagacagagccgaattgaccgagcggaacgagaatcagcgcggtaatcaagggcgccatcgcctggccggtattccctccgacttggtaaatcgattgcgccaagccgcgcttttcgccggcggccatgtaagcgacacgcgatccttcaggatgaaagacggcggagccaaggccgataaaaaagacacagcataaaatcgtcagaaaagacggggcgaacgcgagacctaaaatgccgagcatgcttgcggtgagtccgagcggcaaagcatacggcatcgggcgtttatccgtataccagccgatgacgggctgcatcacggaagacaccatattcagcgtaaaggcgataattccgagctgcgtaaatgtaagattcatggaacgttccaaaatcggaaacatcgccggaatcaccgcttgcagtgaatcgttcagcagatgacagatcccgataatgaacagaatagaatacatggttgtctcgggacgatggacaggtttttctttaagcggggcggcaattgccaaagtgattctcctcctttttatgtaaacgaagcatacaccatattattcataaggtgaatgaattatcaagtgcaaaaaaggctcttctttctcaaacagaaaaaagagcctccctttttatttatttaacaaactgtgttttctcgaatacatcatataaacgacgatcccggcggcgatccagatgacaaaggcgagccatgtcacgcccggcaggctgcttgcgagatacaggcataagcatgcgctgatgatcggcacaaaaggcacgaaaggaacacggaaggaagatttgatctccggatgtttctttcttaaaacgatgacggcgatcgcaatgaccgtaaaggccgccaaggttcccatattgacgagatgcgccaaggttcccagatcaataaaacctgcgatcccggcggcaacgatccccgtcacccatgtgttttgaaacggtgttttaaaacgcgggtgaaccttggaaaacatgcggggcaagaggccgtctctgctcatcgcaaatgtaaggcgcacctgagcgtaaagcagagcgagcatgaccgttgtaatcccgataatcgcgccgacggaaataatgcctgctattttgttctggccgacaaattggagcgcgaaagatacagggtctccgacattcagcttggtatacgaaagcattcccgtcaggacaagcgataccgtaatgtaaaggacggtgcagatggcaagcgcgccgatgattccgacaggcattgatttctgcgggtttttcacttcttccgacgcgtttgacacggcatcaaatccgagatacgcgaagaaaacggtcgcggcgctcgtgatgacgcctttcattccgaacggcataaacggcgaccagttttccggtttcacgtagccgaaaccgacgacgataaacagcagaatgatcgcaattttcatcaatacaatgacattgttaaagcgggtgctttctttcacgccccttgaaacaatcgcggtaatgaccaagataatgataacggccggcaggttgaacacggcacccgttttgctgccgggtgcggcggtcagcgcctccggaagatgcagcccgaagcctgcaagaagcgactggaaataagatgaccagccggttgcgacggcggcgagcgcgataacatattcaagcattaagtcccatccgattaaaaacgcgagacactccccgagagtgacatatgaatacgtatatacgctgcctgaaatcggaatggatgaagaaaattccgcataacaaaacgcggcgagcgcgcaggcaaggcccgcgagcacaaacgacagaatcaaagccggtcctgcgcctgtcgcggccacagtcccggtaatcacaaaaatccccgtgccgacaacacagccgattccgagcaaaaccaagtcaaaagcgcttaacgagcgggacaggctggtctgtttgctctgggcctttaagtcggccagcggctttttccgaaatagtaaagacatatgggtcctcctgaaaattcataatattcttatcattatatacactgacgtttgtattatattgtcgaaatttctcgcagtcaattaaagaattttccactttaaaaggacaaagctaaaaagcgtcgatgcacggaaggaaagggaattttattgtgaaatagttcaattttctcaccttaagaccgatacaaaagatgactcatcaactaatttcaagtttcggtgaaagggagatgtttacatgtttcaatatgaagaactaaataagcagtttatcggcggccgatggagggatgggagcagccggaacgtattggaaaacagaaatccttatactcaaaaagtcatcacctcattccgaaaagcgacgcctgatgacgtggatgcggcatatcgcgccgcggctcttgcgaaacaagaatgggacaaagtaaacccttttaaaaagcgggccattttggaaaaagccgtttctttcattgaagagcacgaagaagcgattatttacttaatcatggaggagcttggcggaacacggctgaaggctgagtttgaaatcggacttgtcaaaaatatgataaaagaagccgcaacatttccggtgcggatggaagggaaaattctcccgtccacgattgacggaaaagaaaacaggctgtacagaatacccgccggagtcgtgggggtgatcagcccgtttaatttcccgtttttcctttcgatgaaatctgttgcgccggcactcggcgcggggaacggcgtcgtgctgaagcctcatgaagaaacgccgatctgcggcggaacgcttatcgcgaaaatttttgaagcggccggcgtaccggacgggctgctgaatgtcatcgtgacggatatcggggagatcggcgacagctttgttgagcatcccgtgccgcggataatctcatttacaggttcaaccggagtgggcagctatatcggacagcttgcggtcaaacactttaaaaaaccgctgttggagcttggcggaaacagcgcgctgatcgtgcttgaggatgctgatcttgaatacgccgtcaatgcggccgtattcagccggtttacgcatcaaggccagatctgtatgtcggcgaaccgcgtgctcgttcacacatctgtatatgacaaatttacagagctttacgaagcgaaagtgtcatcgctgaaagtcggcgatccgatggaccctgatacggttatcggtcctttaatcaatgagagacaggcggaaggtctgagacggtctgtcgaaaaagcgatagaagagggagcggttccggtgctgtccggccgattcagcggaacggtcgctgagcccgtcattttaaaagatgtgaaacctgagatgagcatcgcgaaggaggagctgttcggaccggccgtctgcatcatgccgtttgaaacggaggatgaagcggtaagcatcgcaaacgcgacaccgttcggtttaagcggagccgtgcatacggcaaacgtggagcggggcgttgagtttgctaagcggatcgaaaccggcatgattcacgtcaacgatacgaccattaatgatgaaccgaatgtcgcgttcggcggcgagaaacaatcaggtctcggcaggctgaatggcgaatggagtcttgaagaattcaccacgctgaaatggatttcggttcagcataaaaaacgtcaattcccatattaagaaggagtgaaagaaatgagtatacagacggagcagcaaacgcacagcctgcttgacgcttttgtcaaagttgcgccttttttaaacagcctgatccaagatgacatcaccatcggaatttatgatacagaaaaattaatcgtgaatattccggctaaaacgttttctcttaatgtaaagccgggagacccgctgcaaaaaggggacatcattacagacgcgatccgcatgaatcagaagaagacaagcatggtgccgaaagagctgttcggatttccgctgatcgccagagcgattccgcttcatgatgaaaacggaaaagtcatcggcggcgtcggtctcggcacgagccttgaaaaatcagccaagcttcatgatgtcgctgaaagcctgtccgccgtcgtggaacagaccgcttcggccatcgcggatatctcagaatccatcaacggcttttcagcacagatgaccggaatttccgctcaggcgaaacaagtcagtgaaagcgcgggagaaatcgctgacatttccgtcactgtcaagggcatctcggatcaaagcaatctgctcggtttgaatgcggccattgaagccgcgagagcaggagaatccggcaagggcttttccgtggtggcggatgagatccgcaagcttgccactcattcaaaagacaatgtcggccaaattgaccagattacgaaaaaaatccacagcctgctgaaagggctggaggactcaattgaatccatcaaccagaacacggacggccaagcggcggcggttgaacaaatttctgccacgatgcaggagatttcaggaagcgcccagcatttagcgaaaatggctgaaaacgttctcggagaatcataaaaaaaggggagcttacgggctccttttttgttttccctttatcaagcggaaactgcacttacacgtttgatccgtcatgctaaaggggtacacatacgaatacatcaccaatgataaaggagagtcttgtatgtctgatgcaaatctgcacaacccgctgacgaaatatgatcatgatgaatttccaaaacaatatcaagaaccgcccggcttgcagaaagagatgaagcctgtgccggattgcggtgaaacaagctataaaggagccggcaagctgaagggaagaaaagccctcgtcaccggcggcgattcaggtatcggccgggccgccgcaattgcttatgcccgggaaggggcggatgtggccattaactatctgcctgaggaacagccggatgcagaagaagtgaaagcgttaattgaaaaagagggaagaaaagccgttctgctgccgggagatttaagcgatgaagcgttttgcggagaattggcggaaaaagcgtatcaagagcttggcggtcttgacacgctcgctcttgttgccggcaaacagcaggcagtggatgatatcagcgatcttactacagaacaaatctatcaaacatttgaagtcaacgtattctcactgtattggctcgtcaaagccgcgcttccgtatctgccggaaggcgcgtctattatcacgacaacgtccgtagaagggtataatccaagcccgatgctgttggattatgccgcgacgaaacatgccattatcggttttaccgtcggcctaggaaagcagctggcgaataaaggaatcagagtcaactcggtagcgccggggccgatctggacaccgctgcagatttcaggaggacagcccggtgaaaacattccgaaattcggcaaggaaacaccggccgttccattacagcgtgccggacagccggcggagctggcaggaatttatgtctttttggcctcagaagaatcgagttatgtgacatcccaaatttacagtgtaagcggaggaattccgacagcgtaatcaaaaaggagctgcccttcatacgggggcagctctttttttcgatgttatgtgccgaggacgttttgattatacaggacactcggatgtgacggatgataggaggcggctttgtcgttatgaatcttcgctttttctctgtcgccgagctgccagtggcagacgcagagctgcagatgggggtaccaggtggaatattcgagctgggtaaagcctgcatcactgcttttggcggatagggcgagctcataccaaaacacgccctgccggtattgccgtttctccgcaaaatagtcgccgagcctgcagcagaactccggccgcggacaatcgatcagaaatgattttaagagagacgtcatggcggcctcttcatggccgaccgccctgtagcaatcggatagatattggcacgttctgatctcgtcttcgatccagcactgttttgtggaaagaaaatggtgataatacgtaatggcgcgctgatactggccgtgatcctttaattcattcgcgaagtaaaacaaatcgcgcggtgtcatcgtttcactgttttccgccattttctcataaatcttcaagttgcggtccgagggaggcgagtgctttttctcggatttccggtgtgtgacggcaatatcggtttctatgatgtttccgtatacttcaagatactcatgcacggctccgatccagcggaatcctttttcacgcttgacgagtcggttgcggcggtatctgaagctgacctctccccgatcatcaaagccgacgtgataatacatggataccgcgtccacctcttttgaaagcgacgcctttagttcaatcagcttttcacggtccttttccgtcagcatatcgtcggcgtccagccacagaatataatccatttccgctttcgaaaacacaaaattacgggcggccgcaaagtgatcgatccattcaaaatcataaatcttatccgtataacgggccgcgatttctttcgtccggtcggtcgagcccgtatcagcaatcacaatttcatccgcaatgtctttgacggaatcaagacagcccgcaagcacctcctcttcatttttcacgataacgcacaaactgacgctgatcatgtcatcacctcttcccctccagtgtataaaaggagaggcggaaacattcttcggacaaaatgatctcttccaggaaatttgtctgtccttttactagttttattccagcgcctgatttaaaatgaacacatgaacttacgtgaggattgataggaaccatgagcatcataaaagcggaaaacctttataaaacatacggagataagacattattcgaccatatctcctttcatattgaagagaatgaaagaatcggtttaatcggcccgaacggaacggggaagtctacgcttctgaaaaccattgccggccttgaatcaacggaggaaggcgagattacgtcttcaggaaacgtgcatattgagtttttgcatcaggaccctgagcttccggccggacaaaccgttcttgaacatatttattccggcggattagccgtcatgagaacgatgagagaatacgaaaaagcgcttcaggcgctgaatgaagaaccggaaaatgaccagcgccagaaacacctgcttgatgcgcaggcccaaatggacgcgaatgatgcgtgggaggcgaatacgttagccaaaacggttttaaccaaacttggcgtcaccgatctgatgaaggatgtcagtgagctgtccggcggccagagaaagcgcgtcgcgattgcgaaaaacatcatccagccggctgacctgctcattttagatgaaccgacaaaccacttggacaatgaaacgattgaatggctggaaggctacttatcgcaatatccgggcgccgttatgcttgtcacgcacgacagatattttctgaacagggtgacgaacagaatttacgagcttgagagaggcagcctttatacgtataaaggaaactatgaagtattcctggaaaaacgggccgaacgggaagcgctggcggagcagaaagaaacaaaacgtcaaaacctcctgcgccgcgaattggcgtggctcagaagaggagcgaaagcgcgctcgacgaaacaaaaagcgagagtggacagagcggaggcgctcaaggagcaaaaagggccggcagtctccggatcactcgatttcgcgatcggttcccaccgtctcggaaaacaagtaatcgaagccgataacgtcgccattacctataacggccaagcgctgatcagccagtttaatgagcttgtcatcccgggggaacgaatcggcatcatcgggccgaacggaatcgggaaaacgacacttttaaacagcctcgccggcagaattcagcctgacagcggtaatatcaccatcgggcagacggtccggatcggctactacacccaggatcacagcgaaatgaacggtgatatgaaagtcattgactatataaaagagacggctgaaatcgtcaaaacggcggaaggcgatgtcatcaccgcggaacaaatgcttgagcgttttctgttcccgcgtccgatgcagcagacatatatcagaaagctgtcgggcggggaaaagcgccgtctgtacttgctgaatgtactgatgcaggagccgaatgtgctgtttttagatgaaccgaccaatgatctggacacagaaacattaagcgtgctcgaggattatatcgaacagttcccgggcgtcgtcatcactgtatcccatgaccgctatttccttgaccgcgtcgtggaccgcctgattgtatttgaaggacacggcatcatttcccgtttccaaggttcgtacagtgaatacatggaacaagcaaaagcgaagaagacggcggtaaaacagccggccgaagaaaaaaaggcggaagaagagccgaagaaaaagcgcaaaaagctttcgtacaaggatcagatcgaatgggacggcatcgaagacaaaatcgccggccttgaagaaaagcatcagcgtctggaagcggaaatcgctgaagcgggaagtgatttcggaaagatacaagaactgatggccgaacaggcaaaaacggctgaagagcttgaagcggcgatggaacgctggaccgaattgtcactgatgattgaagaacttgagaattaagaaaagccggtacggcccccgagaagacggcgggtcataccggctttttgttttaaacaaatgtctcccggcgctttaaagacaaaggttccgtccaagctaagtttattcggcataaaaagtttacgtttacgttaaggttcaaatggtgtataatagaaacagatacgacaagagggggattcaccttggaatggatgaagattgatcaagttgccaagcgaagcggactgacaaaacgaaccattcgtttttacgaggagattggtttgattcctgctcctaaacggacagaaggcggcgtccggctttactctgaagatgatatggaggagctcgaaaaagtcaccagcacaaaagaagtgctcggtttttcccttcaggaacttcagcagtttatggagatgagccgtcagctggaattaaacaaagaggggtacttgttgtcactggatccgaaggaacggaaagaaaagctggaagagattcagcacgctttgaaccaccagcttgagatgattgatgagaagatcagcacatttcagcattttaaaacgcgccttaacggaatgaaagaaaaagctgaccgcgccattcaatcaatcgaatgattttgctgtaaacgctatggatatagcgtttcttttaatggataaaacaggaggtctggtcaaatggatacatcatcacaacagaaaacaggcttattcagccagccgaaagccgtttgggcggttgcgtttgcctgtgtgatttcctttatgggaatcggtcttgtcgatccgattcttccggcgatcgccgcacaattacatgcttcacctagtgaagtatcactgttatttacaagttatttgctcgttaccggttttatgatgtttttctccggcgcgatttccagccggatcggcgcaaaatggacgctgcttctcggacttatttttatcatcgtgtttgccgctctcggcggaagctcaagttcaatcgctcagcttgtcggctatcgcggcggctgggggcttgggaatgctctctttatttcaaccgcgcttgccgtcatcgtcggggtatctgtcggcggcagcgccaaagctattattctgtatgaggccgcgctcggactgggaatttccgtcgggccgcttgccggcggagagctaggcagcctttcatggcgcgctccgttcttcggagtgtctgtcctgatgtttatagcgctttgcgcgatttcactcatgctgccgaagctgccgaaaccggcgaaacgcgtcggtgtgtttgatgcgatgaaggcgctcaaatataaaggccttttgacaatggcagtatctgcattcttatacaactttggattttttattttgcttgcttattctccgttcgtgctggatttagatgaacacggtctcggatatgtcttcttcggctggggccttctgctggcaattacgtcagtctttacggcgccgctcgtgcacaaagcgctgggcacagtgcgttcgctcgtcgttctctttatcgcctttgcggccattctcgttattatgggggtctggactgaccatcagacgttgatcattacatgtatcgttgttgccggtgctgtcctcggtatggtgaatacgatcatgacaaccgctgtgatgggtgctgcgccggttgaacgttcaatcgcgtcttcagcctacagctcagtccgctttatcggcggtgcgctcgctccgtggattgcgggaatgctgtcagaacacttcaccgcaagcactccatatacagtaggcgggatcgtcgtttttgtaggcatgcttgtccttctcatgggacgcaaacatctcgccggaataaaagccggacattaagaaaaaaaggaacttccgcacgggcgggagttcctttttgtgtttacagcacttttgtcgtccaagactcacaattccatgtttccgtcgcgatatccatgtaaaactcgggttcgtgggaaatcagcagaatggagcctttgtattctttcagcgcgcgtttcagctcttctttcgcatcgacatccaggtggtttgtcggttcgtcaagcacaagtagatttgtttctgaattgatcagcttgcacagtctgaccttcgctttttctcctccgctgagaacggagacgcggctttcaatgtgtttggtcgtcaggccgcatttggcgagggcggcgcggatttcgtactgggtaaaggaaggaaattcgctccacacttcttcgatgcacgtattgttattggtttctttcacttcctgctcgaaatagcccgtgtattgatgctcgccgcgctccaccgtgccttccagcggctggatttcaccgagcaggctttttaacagcgtcgttttcccgatgccgtttgcgccgtacagggcgactttctgtccgcgctccattctgagattgagcgggcgtgacagcggagtatcgtaaccgatgactaagtccttcgtttcaaaaatgagcttgcctgacgttctcgcaggcttgaaatggaattccggtttcggtttttcggccgccagttcgatcatatccatcttatcaagctttttctgacgggacatcgccatatttctcgtgctgacgcgggctttgttgcgggcgacgaaatctttcagctcagccacttcctgctgctgttttttataggcggcttcgagctgctgttttttcacttcgtagacttccataaactgatgataatcaccgacataacgcgtcagctcttgattttccacatgataaatcaaattgattacgctgtttaaaaacggaatgtcatgggaaattaagatgaacgcattttcatattcctgcaaatagcgtttcagccattcaatatgctgttcatcaaggtagttcgtcggttcgtccaacagaaggatttccggcttttccaaaagcagtttggcgagcagcactttcgtccgctgtccgccgcttaagtcagtgacgtcgcggtctaggccgacttcctgcaggccgaggccgcgggcgatttcttcaactttgctgtcaatcacgtagaaatcattgtttgtcagggcgtcctgaatgacaccgacatcttcaagcagctgctcaagctcatcagggtccgcttcgcccattttgttgtaaatctcgttcatttcttcttccatcgcaaataagtaatggaacgcatccttcagcacgtcgcggatcgtttttcctttttcaagcacggtatgctgatcgagatagccgacacgcacgtttttcgcccattcaaccttaccctcatcaggctcaagctttccggtaataatattcataaacgttgatttaccttcgccgtttgctccgattaagccgacgtgttccccttttaaaagacggaacgatacattgttaaaaagcgcacggtcaccgaagccgtggcttaaatcttttacggataaaatactcatcattacacctctatcgttatcagacacgctttttttatcatgtgtctttctcatttatgattataaaggaggagaccgtttgttaaaaggcttggaaggaaaaagaaaattgcgtttgccgcgtgcatttgagatactatggagtagattttaagaattgaggagaacgacatgacccaaacatggccatttttacagcatacacaaccatttatcgccgaaaactgggaggcgtcaggttttcaggagccgaccgttattcaggaaaaagccgctcaggtgatcatggaagggaaagacgtcattgccgaatccccgacgggaacgggaaaaacattggcgtacacgcttccggttctggagcggatcaacccggaacagaaacatccgcaagtgatcattttagcgccgtcccgcgagcttgtgatgcagatttttcaagtgattcaggagtggaaaaaaggctccgatcttcgcgctttgtctttgatcggcggggcaaacgtgaaaaagcaggtggagaagctcaaaaataaaccgcatatcattgcaggcacaccgggcagggtgctcgaattgattcaggcgaaaaagctgaaaatgcatgaagtcaagacgatcgttcttgatgaagcggatcagctcgtgacaaaggaacaccgcgaaacgatgaaaaaaatcattaaaacgacgctgaaagaccgacagcttttaagcttttccgctacgctgcagccggagacagaagaggtgctgaatgccatcgcacatgaaccggccgttttgaaagtggagcggaatacggcggaaaaagcgcgcgtcacgcatcaatatctcgtctgcgatcagcgggataaagtgaagctattgcaaaagctgtcacggctgaacggcatgcaggcgctcgtgtttgtcagagatatcggaaatttaagcgtctatgcggaaaaactcgcctatcatcacgtggatctcggcatcctgcacggagaagcgaaaaaaatggagcgggcaaagatattatcagcgtttgaagggggagaatttccgctgcttctggcgactgacatagcggcgcgcggacttgatatcgatgatcttccgtacgtcattcacgcagacatcccgaatgaagacggatatatccacagatccggccggacggggcgggccggtaaagaaggaaccgtactcagccttgtcacgccgatggaagaatccaaattgaaaaaaatggccaaatcactcggaattgagctgaaagaggccgtttattcaggcggaaaattatctgagaaataagaaacggagggcgggaagcccttcttttttcattgtaaaataatagaaaaggttcgggcaggggagtgggaagatgggttcaatagaccgatttcaaatattgaaggaacgtgagctgaaaatacttgaacactggtttaagaacgataacatcagacggagaatggatgcgatgctgccattagacgcgtggtatgcacgattgaataaagatgaagacgatactgtcattatggcatatgacgggcagcttccggcaggaatggtctctatagagtttgtggaggaacgggcgtatatcggattgatcgtcaatcctttgtaccagcttcaagggtacggaaaacagattttgcaaaaactgctgactgatcctgggtttaccggcgtgcgggaatgggcggcaagcatcgaaaaagacaatcaaatcagtttagcctgctttcaagcagcgggattcactttggaagatacggagcctgatgaagacggctttctgactttgattcttcgcggctgatgcgaaaaagcaaaaggaggggacaaagccctccttttttcatcatcatgttaacttagatcactgactttgatgatctgtttgcctttgttttctcctttaaacaggccgaggaacgcgtcaggaatatggctgaatccttccgtaatcgtttcttcataatgaagcttcccgtccttgagccattcggccaattgtttcgcgccttcggaaaagcggtcagcataatcactgacgatgaacccctgcatcagcgcttttgttttgatcagcttcggctggacgcgggggcccatgtcttcctcttcactttcggtattatatgaagagatcgctccgcataccggaatgcgggcgaattcattcagcaggtttatcaccgcatctgaaatcggtccgccgacattgtcaaaatagacatcgacgccgtcagggcatgcctgttcaagcgctttttgaatatcatccgccgttttgtaattaatggcttcatcaaattgaagctcctctttcagatacgcgattttttcgtcagaaccggcgatgccgacaacccgcgcgcctttgattttggcaatctgcccgaccgttgagccgacggcgcccgcagcccctgaaacgacgacggtttcgccctttttcggacggccgatatcgagcagcccgaagtaagcggtcagtccggtcatccctaaaatgccgagatacgcctgggcgggtgcgatatccgtatccaacttgcggagggcggactcattgacggctgaatattcctgccatgcgagatttccgatcacaacatctccttttttcagcttatcgccgtctgtcagaacttcggcaatcactccgcctgttatggcttcatctaaagcgaacggctctacatatgattttgtatcctgcatccgtccgcgcatgtacggatcaacggacacataactcgttttcacaagcacttcgccgtctttcggttcgggaacggcaatcgtttcaaagcggaaatcgtcatggacgggaacgcctttggggcgtcttgccaattgaatctgctgctgatttttcggcatgatgcatcctccttcaacatgagtgtttgttccaaatgtaacacgaaccatttcccgaatacaaaatcaaaccgtccgccggcaacaaaaaaagaagggccagggcccttctttccttatatgcgtatttaaaagaataaccggtacacatcggtgtttttctcatgttccaaatattcataggcattcgtttttgaagaatgaagcatgtcagcggtaatgacgggctgaagcgcggtcagataagaacccagcttattttcaatttctttcggcagaacggattcgatatcaccgatattgataatgatagagaaaacgaaatcgatattaatatgaaaagtatcttcagcaaagaccgtaagctcttttattccatccgggcagcgggtatgccggcggaatacctgcttcactaaatcactgacaacccaagcgttaaatcgctgttccggtgaaaagtaatgaataggaaccacctccctgcttaatcggctcatgaagatttttatttttctgaaaatgtagctttccctactgtaacatgtcccgccggaaaatatccaccgacaatctgcccgttttttcccggaactctctttcttttgtttgacctttggttgagcgggtaaacatccaatatacaaaaacaaaagggaggacttatcaatgaaaccggtagtaagagaatatacaaatgatcaaaaactgatgcaggacgtaaaagagcttcagcaattgggtgtcgcaaaagaagacgtatatgtgctttctcatgatgacgacagaacggaccgcctggcagataatactgatgtcaataccatcggagcgaaagaaacgggcattaaacacgcggtcggcaatatgtttaataaaaaaggcgacgagctccgcaacaaaattcacgaaatcggcttttcagaagaggaagcatcacaatttgaaaagcgcttagatgaaggaaaagttcttctatttgtcacggataacgaaaaagtaaaatcatgggcgtaagctgaacagatcccaaggggttttcggtcccttgggatttttttgcggtttccgcaataaaaccgaaaggcacatgctgtacattttcggtgccgtttctcaactgatttgatagaattcaattgtaataaattggaacgaaaaatcaggaggagtacaattcatgaaaaaaatgttatttatgctggcggtttgtttatgtatgatccctgcggacgtctatgccgctgacctgggacggcagacgttaggaacaaatgacggctggggagccgcttccggcgggacaaccggcggcgcgaaagcctcttcatcgaatgtctacaccgtatcaaacagacagcagctcgtttctgcattagggggaagcgccaacagcacgccgaagattatttacatacaaggcacaatcaatatgaatacggacgaccggaataaaacgctcggctttaatgattataaagatccggcatatgatctcaacgcttatctgaaggcgtacgacccggacaaatgggggaaaaaagcgccgtcaggcacccaggaagacgccagacagcgatctcaaaaaaaccagaaagcacgggtcgtgattgacattccttcaaatacgacgatcatcggttcgggttcaaatgccaaagtgacaggcggaagttttaatataaagaacggcgtcgacaatgtcatcatccgcaacattgaatttcaagacgcttacgactattttccgcaatgggacccgacggacggcagcagcggcaactggaactcggaatatgacaatatcaccattaacggcgcgacgcacatctggatcgatcattgcacctttaatgacggatcgaatcccgacagcggttttccttactattacgggagaaaatatcagcaccatgacggccagacggatatagccaacggggcgaattatattacattgtcctataataaatatcatgaccatgacaaaggctccgtcatcggaaacagcgacagcaagacgtcggatgaaggaaaactgaaggtgacccttcaccataactattaccagaacatcgtccagcgcgcaccgcgggtccggtacgggcaggttcatatttataataatttttacgcaggctctaaaagcgccgcatacccgttcagctatgcgtggggcgcaggccacgcgtcaaaaatatatgcccagaataatgtctttgaagtgccgggactggctgctgataaagtcatcagcgtcttcagcggcggaaaagcgcttcatgaagacggcactcttttaaacggcgcctccatcaacgcgtcagccgccaacggattaagtcagtccgtcggctggacaccgtcattgcacggttccatcggctcatcatcaaatgtaaaatcagatgttatatctaaagccgggtcgggtatattaaaataataaacaagaagcacaaaggaaaatattcctttgtgttttttaattaacaaaaacgtttattaacttagttaagtagtaaaatgggataggggatggaagacaacaaaataggaggagacctgtaatggcttcagaaaaagacgcaaaaaaacagcaggcagtaaaaatcattcctttgcttattactgttgctgtgggattaatcatttggtttattcccgcgccgtccggacttgaacctaaagcatggcatttgttcgctatttttgtcgcaacaattatcggctttatctccaagcccttgccaatgggcgcaattgcaatttttgcattggcagtcaccgcgttaacgggaacgctatctattgaaaatacgttaagcggatttggaaacaagacaatctggctgattgtcatcgccttttttatttcccggggatttatcaaaaccgggctcggcgccaggatttcttacgtattcgtacaacggttcgggaagaaaacactcggcctttcttattcactgcttttcagtgatttaattttatcacctgccattccgagcaacacggcacgggcgggcggcattatttttcctattatcagatcattatccgaaactttcggatcaacgccggcagacggaacagagcggaaaatcggcgctttcttattaaaaaccggttttcaaggaaacttgattacgtctgcgatgtttttgacggcaatggcggcgaacccgctgatcgccaagctggcccacgatgtcgcaggggtggacatcacatggacaagctgggcaattgcggccattgtaccgggattggcgagcttaatcattacgccgctcgtcatttataagctgtatccgccggaaattaaagaaacaccggatgcggctaaaatcgcaacggaaaaattgaaagaaatgggtccgtttaaaaaatccgaactctccatggttatcgtctttttattggtgcttgcgctgtggattttcggaggaagcttaaatatcgacgcaacgacgacggccctgatcggattatccgttttgcttttgtcacaggtattaacatgggaggacatcaaaaaagaacaaggtgcatgggatacgctgacttggttcgcggcgcttgtgatgctggcgaattttctgaatgagctcggcatggtgtcttggttcagcgatatgatgaaatcatctgtttccggtttttcatggattgtggcatttatgattctgattgtcgtgtattattacacgcattacttctttgcgagtgcaaccgcgcatatcagcgccatgtatgcggcatttctcgccgtcatcgtggcggcaggcgctccgccgctgttggcggcgctcagcctggcgtttttcagcaaccttttcggttcgacgacgcattacggctcaggagcggctccggtctttttcggagcgggttatatatcgcaaagcaaatggtggtccatcggctttatcctgtcaatcgtccatattgtgacatggcttgtgatcggcggattatggtggaaagtattagggttatggtagaagaaaaaaggcagactcaggtctgcctttttttatttcggtaaggaatgggaagggcctgcacatgatgacttcaatgcgaatagaatattgccggggtgatattatgagcagcggccgtaatcaatacatgatattgaaacagaaaccttacaaatatatgagcagacatatgaaacgccggtatgaacaattaccatgtgaacttgaaagtccggaaacagggacggaaaaacggtttccgtcttcagatgaaaatcgatctgccttgtgcgtacccgggctgcgaggtcccgaaggcaaaagaggacccgccggctcccgcggtccgcaaggggaggcgggtccgcccggtcccccggggcctgagggtccgccgggagcggttcctgcggtagcttttcaaaatacagcagaactaatgacgattccgttagaaggaacaccgataaacgtgttaagcgcagtgatagctgcgccgacagatcaattggtgaaaacggatgccgtcatacaagtaaatgtggaattagatccgctcgcgtctcatttctcattggtcttagctgtcgagctgcaaagaaatggcgtatcgatacaaacacagagacaagagaggaacctcttttcttcaggcgggcaaatcataggaattccttttacgtacatcgacgaaatgaaggcggatgaaacagccgcgtatcagctctatttatccgtcctttcttcgaactacgtaacacaagtcgcagcggcaaaccgctccctcattgcgacgggattccccattcaaggatcagattaaggtgatgaaaagaaatcaccttttttatttaggttgtcaaaacacagcccgtattaatatgctgtcttaataagtaagacggtcaacaacgggaaggagagggaaaaagattgaatgaataatccgattataaacggaagctttgaaaccggcacattagcggggtggagttcggcaaatacccagattaacagtttgtttgcacattcagggagatattctgcgcaatttattggagctcagccatatgcttacctcagtcaaatcgttcccatttcagccaagtcagtgactctattcgtatcactcgcaacgctcggaaatgagccaagtccccaagtcactctccagatcatctatgtcagcgcagcaggtgaacaaatcagttccattcaagaaaatatcacacccggaaatttgccgaacgtgctctttcacacatggtctgaaatctataaaacaagcagtgtgccttctggcgcagcctctgccgtcattgtattaagtaaagtttcttccggcacggttttaatagatgacgtttcattggcgcaaaccgggggtgaacctggcgtaacaggaattacaggtcccacaggagtgacgggtcccacaggagtaaccggagcaagaggagcgaccggagtaactggtgcaacgggagtaagaggagcgacgggtgtaaccggcccaaacggagtaactggtccgacaggagtaactggagctaccggctcgactggtgtaacaggagcaaccggaatcacgggctcaaccggagtaacaggctcaaccggtgcaaccggagtaaccggaataacgggaacaaccggagtgactggtgcaacaggagcgaccggagcaattggttcaaccggaccgacaggctcaacgggagcaaccggcccaaccggagcaaccggctcaacaggtccaactggagtaacaggtgcaacaggatcgacaggcccaaccggcgcaacagggccaacaggtttaacaggagcaaccggcccaaccggagaaactggtgtgactggcccgattggggtcacgggatcgacaggagcaaccggggcgacggggataaccggctcaaccggagtaacaggtccaacgggagagatcggccccaccggagtaacgggtccaactggagtgactggctcaactggtgtaaccggccgaaccggaataacaggctcaacaggaacgaccggcccaaccggaataacaggtccaaccgggccaacagggtcgacaggttcaactggagtgactggtgcagcaggatcaactggacccacgggagagatcggtccaactggatcgtcaggctcaactgggattaccggcgcaacgggatcgacaggagaaacaggcgcgactggctcaacaggagtaactggagcaacgggtgtaaccggttcaaccggcgcaaccggagcgacaggtacaacaggccgaactggttcaacgggagaaaccggagcaactggagtgactggtgcaacggggataacaggagcgactggagcaaccggaataacaggggcaacgggtccaacaggatcaactggttcaacgggagaaaccggtgcaactggagttactggctcaaccggagtaactggtccaactggtgtaacgggatcaacaggtgtaacaggagcaaccggtccaacgggagagaccggtccaatcggatcgacaggaccaaccggcgcaacagggccaacaggtttaacaggatcaacaggagcaaccggaaccacgggctcaactggagtaacaggggcgactggagcaaccggctcaaccggagtaacgggtctaactggtgtaacgggctcaactggtgtaacaggagcaacgggatcgacaggctcaaccggcacaaccggcacaaccggcacaaccggtgtaacgggagtgactggggcaacggggataacaggagcgactggagcaaccggtccaactggagttactggggcaactggagaaactggctcgactggagaaacaggaccgacaggaccaaccggagaaactggctcgaccggggataccggagctactggagtaaccggcccagcaggagcaacgggatcaaccggcgcaacaggctcaaccggcgcaacaggggcaacgggggtaactggagaaatcggcccaacgggagaggccggtccaaccggatcgacaggcccaaccggaaccacgggttcaaccggaatgactggagtagcaggaacaaccggttcgactggtgtaaccggtgcaacgggagaaactggcccaaccggcgtaactggtgcaacaggagtgactgggtcaacaggagtgactgggtcaacaggagaaaccggagcgaccggtgtaacagggtcaacaggaataaccggagcgaccggtccaaccggagcaacaggtgtaacaggagaaaccggaaccacgggatcaaccggagtaactgggacaatgggagaaaccggtgcaactggagtgactggagcaacggggataacaggagcaacaggcgcaactggtgtaaccgggctaactggaataacaggcgcgacgggcccaaccggtgtgactggaccaacaggggttactggctcaacaggagaaaccggttcaactggagtgactggcgcaaccggtacaaccggaatgacaggcccaacaggagtaacaggcccaaccggtccaacgggtgtgactggagcaacgggagtaactggggcgaccggagaaaccggcccaaccggaatcacgggtccaaccggagtaaccggggcgataggagaaaccggagaaacgggatcgacaggcacaaccggcccaaccggtgtaacgggagtgactggtgcaacagggccaacaggagcaaccggagaaaccggagcgaccggtgtaactgggtcaacaggaataaccggaccgactggctcaacgggagaaaccggttcaaccggagcaacgggtgcatccggggcgaccggcgcaacgggaataactggagaaaccggagcaacaggagcgactggggtaactggtgtaaccggatcaacaggctcaaccggaataacaggggcaacgggtccaacaggggcaactggtttaacgggagtgactgggtcaacaggagaaaccggcccaactggggtcacgggctcaactggtgtaacaggtccaacaggatcgactggcgcaaccggagcgatcggtgtaactgggtcaacaggaataaccggagcgactggtgcaacaggagcaaccggtccaacaggagttactggagcgaccggagaaactggggcaacgggagaaaccggtccaaccggagtaacaggagcaacaggatcgactggaccaacagggctaacaggtttaacaggatcaacaggagcaactggaaccacgggttcaaccggaataactggagtaacaggaacaaccggttcgactggtgtaaccggcgcaactggggcagcaggagaaaccggtgcaacgggagtaacgggagtaactggagcaaccggtccaactggagaaaccggcccaaccggtgcaacgggggtaactggagaaattggcccaacgggagagaccggtccaaccggagtaacaggagcaacaggatcgactggcataacgggttcaaccggcccaacaggtgtaacaggttcgaccggagcaaccggcccaactggagtaacaggttcaacgggagaaacgggtccaaccggaatcatgggtccaacaggagtaaccggtgcaacgggatcgacaggctcaaccggagcgactggtgcaacaggagcaaccggtccaactggagttactggagcgaccggagaaactggggcaacgggagaaaccggcccaacaggagtaacaggagcaaccggttcgactggtgtaactggtgcaacaggagaaactggggcaacgggagaaaccggtccaaccggagtaacaggatcgacaggaccaacagggctaacaggtttaacaggatcaacaggagcaaccggaaccacgggttcaaccggtttgactggggtaacaggctcaactggagcgaccggagtaactggaataacgggcccaacaggatcgacaggcccaaccggagcaacaggttcaatcggagaaaccggagcaaccggcccaacgggagagaccggtccaaccggagaaacgggtgcaacaggatcgacaggaccaacagggccaacaggtttaacaggatcaacaggagcaaccggaaccacgggttcaaccggaatgactggagtaacaggaacaaccggttcgactggtgtaaccggtgcaacgggagaaactggcccaacgggagagaccggtccaaccggagaaacgggtgcaacaggatcgacaggaccaacaggaccaacaggaccaacagggccaacaggtgtaacaggatcaacaggagcaaccggaaccacgggttcaaccggagcgaccggagtaactggaataacgggcccaacaggatcgacaggcccaaccggagcaacaggttcaatcggagaaaccggtccaaccggggtaacaggttcaacgggagtaactggagcaacaggagtaaccggaaccacgggttcaaccggaataactggagtaacaggagaaaccggcgcgaccggtgtaacagggtcaacaggaataaccggagcaacgggatcgacaggttcaaccggcccaacaggtgcaacgggagtaactggagcgaccggagtaactggcccaacaggagaaactggtgcaacgggagaaaccggcgcaaccggtgtaacagggtcaacaggaataaccggagcaacgggatcgacaggctcaaccggcccaacaggtgcaacgggagtaactggagcgaccggagtaactggcccaacaggagaaactggtgcaacgggagaaaccggcgcaaccggtgtaacagggtcaacaggaataaccggagcaacgggatcgacaggctcaaccggcccaacaggtgcaacgggagtaactggagcgaccggagtaactggtgcaacgggagtaactggcccaaccggagtaacgggtccaactggtgtaacgggatcaacaggtgtaacaggagaaaccggagcaactggagtgactggagcaacggggataacaggagcaactggtgcaaccgggctaactggaataacaggcgcgacgggcccaaccggtgtgactggaccaacaggggttactggctcaacaggagaaaccggagcaactggatcgacaggctcaaccggtacaaccggcccgactggtgtaaccggcgcaaccggagtaacaggcccaaccggcgcaacagggccaacaggagcaaccggtgcaacgggggtaaccggagaaatcggcccaacgggagagaccggtccaaccggagtaacaggagcaacaggatcgactggcataacgggttcaaccggcccaactggtgtaacaggttcgaccggagaaaccggcccaactggtgtaacaggctcaaccggcgcaaccggtgtaacgggagaaaccggcccaacaggatcaaccggatcaacaggctcaaccggaataacaggagcaacaggtgcaaccggagcaacaggtgcaaccggagtaaccggagtaaccggagtaactggagtaacaggtgcaaccggctcaactggagtaacaggagcgacaggtacaacaggcctaacgggtccaacaggagcaacaggagcaacaggcccaaccggcttgacaggcataaccggcccgactggtgtaaccggggcaaccggagtaacgggcccaacaggcccaacaggcccaacaggcccaaccggcgccacaggcagtacaccaaccttgctcttcacaagaaccaacgggccgctcactgtttatccgccgttaaatacagaagttcccgttgctacgctggcaatcccagttaatgctttgcagaatgtaaagctggattatgcactcagtgccgcgttaacaactgcagcgaattcaaactttgtttttgaagtgagattatataggggagcagtgcaaattcatacaagaactctgtcgcgaactaatactaccgcagctacggatagtttttcgattgctgatacaacagtggatacagcgccgaccgcaggaacaaatacgtaccagttgagagttgttttcacaactgcaaataatataacagcagcgtcagctctcaatatcgattttaacagcattcgtttcccgacaacctaatgacaatagcagactgatattttaaaaatgaaagacctgacttatgcacagttaggtcttttttctctaaaagctgtgcatggtgcagccttaagaacatttgaaaattcgcccaatagaaatgggattttgccacacctttttcttttgcggaaatattatgcaagaagaggtggtgtaatgagaaaaggagatacttggtataacagatacgactcttgggattacgactgccggaattgtaatgagtgctgctgtcattttcaacataaaagaagaaatcaaaggcgcagttatcaaaaacgggcccattgctgtgaagaattctgttgcaaaacctcttgctgtcatgaaagatggtgtccatgctgtcatccaaatcattttcatgtaagaggattcaccggagcaacggggtgcaccggagcaacggggtgcaccggagcaacggggctgaccggagcaacagggctgactggagcaacggggttcactggagcaacagggctgaccggagcaacggggttcactggagcaacagggctgaccggagcaacggggttcactggagcaacagggctgaccggagcaacggggtttaccggagcaacgggctcgactggtgtaaccggtgccacgggagcaaccggcgtcactggagatcccggcacgactggagcaactggcgccacgggagccacgggagtaacgggagcaaccggggtaaccggagttactggagtaacgggcttgaccggagcaaccgggatcaccggagtaacaggcgctaccggagtaacaggcgctaccggagtaacaggcgctaccggagtaacaggcgctaccggagtaacaggagcgacaggaataacgggagccaccggggtaacaggcgctaccggagtaacaggcgctaccggagtaacaggagcgacaggaataacgggagccaccggggtaacaggcgctaccggagtaacaggcgctaccggagtaacaggcgccaccggagtaacaggcgccaccggagtaacaggcgccaccggagtaacaggcgccaccggagtaacaggcgccaccggagtaacaggcgctaccggagtaacaggagtaacgggatcaactggagtaaccggggtaacgggagtaacaggagcaaccggggtaaccggagccatcggagctactggagtaacgggcttaaccggagcaaccggagctactggatctaccggaataacgggagccaccggagtaacaggagcaacaggagatactggatctaccggaataacaggagccaccggggtaacaggagccaccggagtaacaggtgctaccggagtaacaggcgccaccggagtaacaggggctaccggagtaacaggggctatcggagtaacaggtgctaccggagtaacaggggctatcggagtaacaggtgctaccggagtaacaggcgccaccggagatactggatctaccggaataacaggagcgaccggagtaacaggagcaaccggggtaacgggagtaaccggagcaacaggcgccaccggagtaacaggtgctaccggagtaacaggcgccaccgggataacgggagccactgggatcaccggagctactggagtaacgggcttgaccggagcaaccgggataacgggagtaacaggagctacaggagctacaggattaacgggagcaaccggggtaacaggtgctaccggagtaacgggagcaaccgggatcaccggagctactggagtaacaggcgccaccggggtaacgggagtaacaggagcgacaggaataacgggagccaccggagaaacaggcgccaccgggatcaccggagtaacgggagcaactggagtaaccggggtaacgggagtaacaggagcaaccggggatactggagcaaccggaataacaggcgccaccggagtaacaggggctaccggagtaaccggggatactgggataacgggagccaccggagtaacgggagcaaccgggatcaccggagtaacgggagcaaccgggatcaccggagtaacgggagccaccgggatcaccggagtaacgggagcaactggagtaaccggagtaacaggcgccatcggagaaacgggagcaaccggagctactggatctaccggaataacgggagcaatcggagtaacaggagctacaggaataacgggagcaaccggggtaaccggagccactggagtaacgggcttgaccggagcaaccggagctactggagctactggatctaccggaataacgggagccaccgggataacgggagcaaccggggtaaccggagccaccggagtaaccggagtaaccgggatcaccggagtaacgggaacaactggagtaaccggagtaacaggcgccaccggagtaacaggggctaccggagtaaccggggatactgggataacgggagccaccggagtaacgggagcaactggagtaaccggagtaaccgggatcaccggagtaacgggaacaactggagtaaccggagtaacaggcgccaccggagtaacaggggctaccggagtaaccggggatactgggataacgggagccactgggatcaccggagcaggcgcgatcattccttatgcttcaggtcttcccactgccgtgacgaccattgccggcggattaatcggaacggtgagccttgtcgggttcggcaattctgtgacgggcgtcaatgtcggagggggaggcgcaattgatcttaccggggctggaggaactctgctgaactttgctttttctgctccgagaagcggaaccattacatcaattgccgcctatttcagtacaaccgcagcattgtcgcttgtcggctcgactgttacgataaccgcacaactatacagttctactgtgccgaacaatacgttcacgccgatccccggagcatccgtcactttagctcctcccctcaccggcgtattgtcaatcggcagcatcagcaacggaatcacgacagggctgaacattgcggtaactcctcaaacccggctgttaatggtattctccgccactgcgacaggcctttcgcttattaatacagtggcgggatatgcaagcgcgggagttacaatttcctgatagattgcagactgacttcggtcagtcttttttatgtgttatatcaattgtgtaaaagtaaatatatacctatcatcacctttttggtaagccgcaagagaaaaagatcacgaaaattctcaaaaatgagaaataaagatttgaaaaatggtatgattttaggaggaaaggacggctggtgctgtgttggaagcgaagcggttttatgtctctctgcaaatgaaaatcgccggattaattacggctttattaatacttgttatcggaacgctcacggttatatttgcctttcagcaattaaaggaagggcagaagcaggctgaacagctggcggtgcaaacggcaaaaaccatttcatacatgcctcccgtaaaagaggcgttccggcttgcggatcaagaggcttttacaaagttagacgtcattgaacaaatgaaagaacaggcaggcgcgcacgccgtctacatcactgatcaaaaagggcatgttgcatttcattcggcccgaagcagtattccgaaagaaaatcaaaatctgcaaaacaaaaccgtcatgttcggcgggtctccggtttccgacggaatgaaggccgtccggggaagcgccccggttattttggaggaaaaaaatcataacgaagtcgtcggaacggtgacagtcgagtttctacaagatgagatagaaaaagatatgaaagcgcatctgcggcatttaggctattttgcatgtttggtgtttcttatcggcatcgggggagcggcggcgctcgcaaaaagcatccgtaaagatacactcggccttgaaccgcatgaaattgcagcgctgtacagggaacgcaatgcgatgctccttgcgattaaagaagggattatcgccgtaaacaaagaaggcgcggtaaccatgatgaatttatctgcggctgatatgctgaatcttccggaaccgatgatcggaaggcatataaaagaaatcatgccgggcgcaaagctcatgccggtgttggcagggggagaaataccgccgaacgtggaggtgcgtgccggagataaagtatttatcttaaatgtgaaagaaatgaaacagaccggacaagtatacggagcggtgatcagcttccgcgaaaaaacggagctcaagaaactgatcaacaagctgactgaaatgaaaaaatactcggaggatctccgggcgcaaacgcatgaattctcgaataagctttacgcgatactcggtctgttagagctgggagaatataatgaagccattgaactgataaaagaagagtacgccatccagaatgaacagcatgaaatcctctttcaaaacattcattcacagcgggttcaggccatactattaggaaaaatgggaaaggcgtctgagaagaaagtgaagctttcaatagatgaaaacagctttttagaatcgctgccggagcatgtgggttcatcccagctcattacgatcatcggaaatcttattgataacgctttcgaagccgtcgccgaaaaagagaaaaaagaggtatcctttttcatgaccgatatcggcagggatatcgtcatcgaagtggcggactcaggagacggcgtgcctcaggaaaaaacagaaacgatatttgaaaagggctactcttcaaaggggacaaggagaggatacggcttagccaatctgaaagaagccgtcagtgaattgcagggatcgatagagatttcgcagcaaaagagcggcggtgctgtatttacggtgtttataccgaaagaaaggccaaagggggaatcggtgtgattaacatcgcgattgcagaggacgactttcgaatagcgcaaatccatgaaaaatttatcgaacatcttgatggattcaatgtcatcggcaaagcaatcaatgccaaagacactatatcgctgcttgagaaacggcagcctgatctgctgcttttggatatttatatgccggatgagctggggacagatctgctcccgcttatccgcggccgttttccttccgttgatatcatcattattacggcttctgccgaaacaaggctgctgcaggaagcgctcagatcaggcgtttcccactatgtcataaaaccggtgtcggcacataaatttacagaagtgcttttgcagtaccgtgaaaaaagagaatggctgcactcacagccggagctcagccagtctgtgatcgacatgtttttcggaagcggtcagaaagaacaaaaacagcacaatgatctgccgacaggcattaattcgattacgcttcaaaaaatcaaaaacgcgctcagaacggcccaaaaagggatgacggctgaagaactgggagaaaaaatgggcgcctccagaacaacggcgcggcgctacgccgagttcctcgtttctcgggaagaagcgctcgctgaattagagtacggcattatcggcaggccggaacggaaatattatttagcacatgaataagggatgggagaaatgaagcggttgggagtgcttcttgtcatgctggcggcgctggtttcttttgacggacggcagatggagggcttccgctcagctgaagggccggttgaaattgtcgtcccggcagcgcctcaagggggctgggacgtaacggcaaaagctttgcaatcggtaatagagcggaagcaaatattaggccggcccgtaaagatcatctataaacccggcggaggcggagacagcggctggaaatatgtaaacgaacgaaaaacggatgtcatcagtatgaattcaagcctgctgttaagcaatgaaattttgggacaaagccggctgaaggcagctgattttacgcctttggccattatcgcaaaagagtggcagaccgtcgctcttcccaaggattcaaagataaaaagcggaaagcggctgctcggcgatattaaagcaaatccgggcggcataaaaatcggatttgcgcccggcctcggaaatgatgaccagctctcctttgcgagagcggcggaaatggccggaatttctccgtttgatatccgcttttttcaatacggaagcagcaatgaagtcattgaagctcttatcagtcacgagatagacgccgcctcaatgaccatttcagaagcgagagacgcctatcggaaagggaaaatcacattggcggccgttacgtctgacaaaaggctctccggcttcagcgatgtgccgacatggaaagagcagggggtgccgtttgtctttgcgcactggagaggcatcatggggccgaaagacatgaccgaaggcgagatcgcctattgggatcaggctttgaaacagattacttcatccgcggagtggaagcaaatgttgaaaaaacgggattgggagagcttttataaaaacagcagcggcgcaaaacgctttttagaagagcagaccgagttctataaagagatgatgagcagcgaaaaataagccttccgcatatttgcggaaggcttttgatttataaatgaacaaaatgaacgaaaaggttataaaaaattaaaaatctttaaaatccaaaatatttacttcaatatccaattctcataagatagcaaaaaggcggataaaggggatcgggcctttaaaatgtaagcgtattcataataagggggacatactgtgttagcaatcttaggctttcttatgatgcttgtttttatggtgctgattatgacaaaacggctttcagtgttaacggcgctcgtattaacgccgatcgtgtttgcgctgattgccgggttttcttttaaccgggtcggcgagatgatgatctccggcattgaacaggtggcgccgatcgcagtgatgattatgtttgcgattctttatttcggcattatgattgataccggtttatttgatccgatggtgtcgcgtattttaaagctggttaaaggcgacccgctcaaaattgtggtcggaacagccgttttgaccatgcttgtcgcactggacggagacggctcgacgacgtatatgattacgacaagtgcaatgctgcctttgtatatcatgctcggaatccgtccgattattttagcgggaatcgccggggtcggcatgggtatcatgaacacgataccatggggcggcgcgacgccgcgtgcggcgagtgcgctcggcgttgacccggcagagctgacggggccgatgctgcccgtcatcgcgagcggaatggtgtgtatgattgtggtcgcttatgtactcggaaggatggaaaggaaacggctcggggtgatcgaattaaaacagccgtcccatacaaatgaaacggctgcggctgcggaagatgaatggaagcggccgaaactgtggtggttcaatttactgttaacgctttctttagtgggatttttagtgtcaggaaaagtgaatttaaccgtgctgttcatcattgcgttttgtatcgcgctgattgtcaactatccgaaacttaacgatcaaagggagcgcatttcagcccattcgagcaatgtgcttgcgatcggttcgatgatttttgccgcaggcgtgtttaccggaattttaacggggacgaagatggttgatgaaatggccatttccctcgtatcgcttattccggaacagatgggaggttttattccggcgattgttgccttaacgagcggtatctttacgtttctgatgcctaatgacgcctatttttacggcgtgctgcccattttatctgagaccgccgtggcgtacggtgtagataaggtggaaatcgcccgcgcttcgattatcggccagccgattcatatgttaagcccgctcgtgccgtcgacgcatttattagtcgggcttgccggggtcaccattgatgaacaccagaaatttgcgatgaaatgggcggttcttgccgttatcgtcatgacggcctttgcgctcatcatcggcgcaatcacgattttttaacataaaacacccggttcgtcgcacactaaaggcatcagaggaggtgccatgatgagtgatccgtttatgccgcttttttcagtgagaagcggcgccggttttaaagcggcggacggcgtttacggactgaccgtgcagattgcgaatgtttactttatcgaaaatccctcagctccgcgggaaatcattctggttgacgcgggaatgcctcaatcggcggagatgataacagaagaaatgaaacgccgattcaaagaggggtatgagctgaaggcggtcattttgacacacggtcattttgatcatgtcggtgcgattgaagaactgcttgagctttgggatatgccggtttacattcatgaaaaggagctcccgtacgtcacggggaaagcggattatccgcctgccaggcccgatgcgaaaaaagggcttgtcgcaaagctgtcaccgctgtttccgcgccatacgatccgcattccgtccgttcaggcactgccttcagacggtaccgttccgtttcttgaggaatggagatgggtgcatacgcccggccacacacccggccatatttcattattccgggataaagaccgcgtgctgcttgccggtgatgccgtgatcactgttgaacaggaatcgcttgcggacgttgtcatacaaaagcaagagcttcacggtccgcccgcctattttacagcggatacgcagacggcggccgcatccgttcagaaattggcggaactggagccggaagcgcttttgacgggtcacggaattccgatgacgggaaaaaactaccgtgaggatttgcttacactggctgaaaaactgcattccgttttgtaaaacacctgcgaaaatcacaggtgttttttcttcgcagtttccagtatgatacaaaaaaaccattgtgttcacacctaaaaacgatacaatgggaaacagatgtaaattgaaggagagagttttttgaaacatacggaaatactttgggatgaggcgaaggattttattgatgtctgctatcacgaactcggaatggaatcgcaaatcaacgcgcgactgcacgcgataaaagatgagatagagcggacgggaagttacgtccatacggcggaagagcttgaacacggggcgaaaatggcgtggcgcaacagcaaccgctgtatcgggcgtctgttctggcaatcgctgaacgtcattgaccggcgcaatgtgaacacgaaagaagaggtgcgtgacgcattatttgaacatattgaaatcgccacgaacggcggaaaaattaaaccgacgattacgattttccctcctgagaagaacggggagaaacaagtggaaatctggaatcaccagctcatccgctatgcgggatatgagactgaaaaaggaagagtcggtgatccggcatcatatgagctgacggctgtctgcgaaaaactcggctggcgcggaaagcggaccgattttgatattctgccgctgcttttccggatgaaaggggacgggcagccggtctggtatgacctgcctcagacgctcgtgaaagaagtgccgatcactcatccggatattgaagagtttgccgatttaaatctcagatggtacggggttccgattatcgccgatatgaggcttgaaatcggcggactgtcgtacaacgcggcgccttttaacggatggtatatgggaaccgaaatcggcgcaaggaatcttgctgacgaaaagcggtatgatatgctcaaaaaagccgcttcggtcatggggatttccgccagcctgaatactgacctgtggaaagatcaggtgctggtggaactgaataaggcagtgctctattcatacaaaaaacacggtgtcagcattgtcgatcaccatacggccgcgaatcaatttaagcgctttgaagaacaggaacaagacgcgggcagaaagctgacgggcgactggacctggctgattccgccgatctcgccggcttccacccacatttttcataaatcatatgacgatacgattgtgaagccgaattatttttatcaggacaagccttatcagtaactgatggaaaaggtgcggtaccctttcagacggtgtgattcttcgatggttacgtttgtgacatttgagaaggggctgccttttctgaccgcttcggcaaattgttttaacgactcttcagggccttcggcaaggatttccacccggccgtcatcacggttttttacccagccggctaccttatgtctgtcggcttccatctggacgaagtagcgaaaacctacgccctgaacccggccgtctgcaatcatatgatactgaagcatggaaaaaccacctttttcttactatgataaaggaaagataggatatttcgcaaaggatgtgaacgaggtgacgcaagactattctgtcttatctatcaatctcggaaagcccgcaattcatgaatttgccggcagacaaatcaattccggcatcatcaagcggcccgcagattctcccgtcatgctgtataaaacccattttgacggggacgggcaggctgatctgaagcatcacggaggtcccgataaagcggtgtgcgtgtatcccgccgagcattattcatattgggaaacaacgctcgcgagaaaacttcccgccgccgcgttcggagagaatgtaacggtcaaaggactggccgaacaagacgtgtggatcggagacgtctttcagctgggggaagccgtcgttcaagtaagccagccgcgccagccctgcgtcaaactcgcgctcaaatatggcatcaaagatatggtgctccgtgtacagcagacgggatttaccggcttttatttcagggtgcttgaagaaggatatgtcgatccgcgtcccgtcctcaagcgtctgtcgagaggcaaagaaagcatttccgtctggtatgcgaacgaagtgaaataccgtgattcaggcaatctgtcagcgattgaagaaatactgcgggaagaagcgctgtcagaaagctggagggagtccttccttaaaaaaagggacaggctcactaatgtatagaaaaaaagccgtgctgcactgacagcacggctgatttacgttatgcttgtttctttgtttccagcagattggcaaggaagtactttttgaagctttgaagctttcttccttcatagtgggtaattccttttttctttaactcttctacataccagcctttactgccataatgcatgtcagaaaactcctttctccgttctcccgctggggagagtttcttcagtttttgccaaacttttggcattgtaacatctataaaaagacgctgaaaagggataacgcaaaaactgagcctttcgattcagagatgtaaagctttcttacatatatatgtaaagggcggtcttttcatgcttaatggccggttaattttaacagcactgttccgagtgtcatgattccgaaaacgacgccgaaataaatcagcatccccttctttttcttcaccccgtaaacggtaagaatgatgctttcaataaagaaaataaacccgaagataataaaccacatgttgaaaaatggctcctttcacagacatatgtccagtgtagcacaactcttataacggagcataaaaaagccgggcactgtatcagtgtccggcaagtttgacgagaagctgggccaaatgctgtttttcattgtcatccgcaatgtcccacagttcttgtaaaagtttttcttccgcattgcggggctcctcgtgtttggcgagatagtccccgaggatggcggcgcttttaatgattttgctgtcatccagacccagtttttttccggcggaaattttctgatgaaggtacgccttaaattcctcgaaatcctctaaaatctgctgtttcgttacgccgtgcatggcgtgtatttcgttttcgattttgattttttctttatcttttttcatgcgtctccctccttcgggttagttgttgtatacctgttcgggagggagatgaaacattacaatgcagttaaaataatcggtttgtcttttgtgatcacgatggtgtgttccacttgggcgacaaggcttttatccggcgttttatacgtccagccgtctcccgcttcaacaatcgtttccgctttcgtggaaataaacggctcaagcgcgatcacggttccgtttttaaacagcgcgttatcaaacggatcgtagtaattcatgatgtggttcggcgcttcatggaggtttctgccgattccgtggcccgtcagcgttttaatgacggtaaatccgttggagcgggcctcatggtagacggctctgccgatctggttttgacgtttgccggcttttgcctgatccaatcctttctgaaatgcggatgctgcgcagttacaaagcttttgcagacgttcatcgccttctccgagcacaaatgaaatgcccgtatcggaataaaaaccgccgaactccgccgaaatatcgatattgacaagatctccggcttttaagattttagaggcgctcggaatgccgtgagcgacttcgtcatttacgctgatgcatgtcacgcccgggaaatcgtattccttctccggagcagaagcggctccgtgctcgtcaagcaccgcctttccgatcaggtcaagatctttcgtgctcatgccgggctcggcttttttcttcatttcttcacgcgccagcgcgacgattctgccgatttttttaaggccttctaattcttgatcgttcgttacaatcattgtcattcccgctttctatttttaatcatctgattcaagcttaccacaactggtttataaatagaaaaccaacaagccttatgtgaataaatgaaggaaaattggtatagatcactagataacttatgtggtatatttaagaaaaaagaagggggatgggtaaaatgcttcaatttttgcaaaaactcggaaagtcttttatgcttccgattgccgttctgcccgccgttggtattattttggccatcggcagagaggacttattaaatattccgttcatttacgcggcggggacctcggtatttgatcatctgccgctgattttcgcgatcggaatcgcgatcgggatttcgaaagacagcaacggggccgccgctctgtcgggagccatttcttatatcatgctggacgcggctgtaaaatcaatcaattcgacaaataatatggccgttttcggagggattatcgcggggttaattgcgggatacacgtataatcgctttaaggatacgaagttgcccgaatatctcgggttttttagcgggcgcaggctcgttccgattgtaacggcgctgattaccattattttggcggggatcttcggatttgtgtggccgccgattcagtcggtgattacgtccttcggggaatggatgatcgggcttggcgggatcggcgccgggatttacgggatttttaaccggcttttgattccattcggtcttcatcatgtgctgaataatattttttggttccagtttggcgattttcacggaaaaacgggagatctggcccgcttctttgcgaaggatccgacggcggggacttatatgacgggattcttcccgattatgatgttcgggcttccggccgcatgtctggcaatgattgccgcggctaagccaagtaagcgcaaagcgacggccggaatgatgatcggtctcgcgctgacggcatttattaccggaattacagagccgattgaatttgcatttatgtttttatcaccgcttttgtacggggttcatgctatattaaccgggttctctttatttatcgtgaatgttctcggaatcaggtcaggtttttcattctcggcgggggcgatcgattatctcctcagctacggcattgccgaaaaaccgcttttgctgctcgttgtcgggctttgttatgcggtgatctattttgtcgtcttttatatgctcatcaaaacgttaaacttgaaaacgccgggacgggaagatgatgaggaagaggaagaagtgcttagtgaagatacggccggttccgtcgaagaacatgccatgctcaaggggctcggcggcaggcaaaacctcgaaacgattgatcactgtgcgacccgcctcaggctgaccgtgcaggatacgtctctcattaatgaggcggcgcttaaaaaagcgggagcaaaaggggttatcaaaacggggaataaaacggcgcaggtcattatcgggccgaacgtcgaatttgtcgcggaagagctgagagaggccgtccgccttgacgatcagaagcagacttgaaaaatccggatcacctatgtgatccggatttttttgaacatatatcaagtttcacataatgtacaaaaaacaatgtttccttctatgttaagattcatgtagaacaagtatggagatgatgtaaggtgacatggattgcagttgtttcaattgttgtcataagcctgattaagattgtgctgacatgccttcctaccggagcggtggaatggatcctccgcaagtttgaaacccattcaaagctcagtgacgagtccgctgccgtttccctcggcggaaaacgtctggaaggcgaagacaaacgacgggtgattgatgattttaacgaagccgtgtttatcgaacggcattatatatacccaggggatgaagagcgttatcttcatccgcaaaacggagccgatccgcttgtcattaagacgagaaaaggaaaaaaagatgtgacggtgtttgtatacagctacgaagatcatgtagatgtcgtcaagcagcagaaaaagaaagtcgtcgcttattcagttctttccgacagcctgcaaaagcgcactatggccgccgccgggagctgaacataaaaaagccagatcatatcaatgatctggcttttgtttattctttttgatcgtctgctgaggaatcttcacgcttcgtataatcgaattgtgacggatccactttcttgaagcctttcggctgatagaaacgaagcagatcgccgttgatgatcttatcagacatttcaagctcagtcttgacgagagagtcttcttttttgtcgacttctgaatcatctaaaagtcttccggttttcgtatcgtaatacttgccggacactttcgtatagttcggcgagatgaagtctccgttacggaacggaatgacttctctgtgctctttcgataagatatcagaacctgacatgagataatctttcgtatcgacgccgagcagatgaagaacggtcggcgcgacatcgacttcaccggcaaatttatgattgcggccgcctttcacgccgggagcgtggataaagagcggcacccgctgaagctgggcattgtcgtattcagtgatctcatctttgccgagcactttcgccatcgctttattatggttttcggagatgccgtagtggtctccgtacatcacgataatcgacttatcgtacaggccgtcttttttcaggtcattaaagaactgttcgattgattcatccagatagttcgcggactggaagtaattattgacgactgaatcgccaaagtctcccgccgggaagtccgtgtcttctttatccattccgaacgggaagtggttggacagcgtaatgaacttcgtatagaacggctgcggcagactctttaagagcggcatggattctttgaaatacggtttgtctttcatgccatagtttttcgtgttttcttcgctcatgtcataataagcggaatcgaaaaacttatcgatgccttccgatttgtacatttcgttacggttccagaaagtctgcgtatttccgtggaaagcggcagacgtgtactttttgccttttaagatcgcaggaacggactgcagcgtgttttgcgctttattgacgaaaaccgaaccttgcgaaagcgggtacagagagttctccatcataaattccgcatcagatgttttaccttgtcccgtttggtggaaaaagttatcaaagtagaatgtttgattatcgtgcgccagtttgtttaaaaacggcgtcacttccttgccgttaattttgtaatcaatgataaaggattgcagagactctaatgagacgtagatgacgttttttccttcggcttttccgaagtagacgttattcggcacgtcatagttggccttcatatagttttccacatccgttacatcgcttgaatcggcaagcgcgcgctggctgtttgatttcacattctgcacggcatcgtaaatcgtaaagttgtacgtgccgaggtatttcaccagatagtttcggtcaaatgagcgtgtcaaaagctcaggacggtctgattccgcgacggcgaggttgatcaggaacacaagcacggcggaagccaaaacgattctgaatgatttcttcgccggtttttcagccggttttttcatcttaagggccaaaataatcaaaatgacggtatccaggaagtagaaggcgtctgtccatctcattaacgagaacgcgctgtctccgagctggccgccgtttgtctttgcctgcatcatgaccgggatggtaatgaaatcattaaagaatctataatagacgatgtttgcaaaaagcaaaaaagacaatataaaatgaatcacaataatggctgtctgctgtaattttttcttgaaaagaagcccaaatccaagaaagaacaagctggagctcagcggattcacaaaaagcaatattttctggatcgtgttgtctatgccgaggttaaagtttaaaatataagcgacatatgttttcacccacaataacacgaccgctatcaagaagaaggcaagtcctctttcttttataaatgttttcattgttacactccttttttccgatcacggtttacacggaacgatagaaaaaacgaacgtaatcaatataccatgaaaccagcaaatagaaaaggtggaaaaggctcatcggaaaaagggcgaaaaacgctgtcgcaacagcggttcatctgttgaatgacagctttaaaaaacataaatggcacaaactgggatgtgaatttccgtatgatcacacccggttctattgaaaaaagaggtgaacagtgatggatattgcccatatcgtggctgaagataaaatcaagcgcgccattaaggatggagagttcgccggcatcaaaggaatgggaaagcccctgccgaaagacgatgccgcacatcttccggagtcgctcagaatgggctaccgcatattaaaaaacgccgggatcgccgaggatgagggcgcgctgaagaaagagctgatgacgctcgattatttgatcgccaagtgccgcaatgaacaggagcgggatcacctgcggaacaaacggacggaaaaacaagtcagactcgacaaactgacggaggagaaagccatgttctcaaaacccgcatcttctcattataaggagaaagtgtacagacggctgggccgcccgtaagccggctctttagatttttttctgaaaaggaatgtgctccataaggcgcgggtaggaaatgtggagcaggccgtttacgcactgcgcctgtaacaggtggggctcagccggttcaggaagctcaatcgtctcatcgatttccccgtaataccggttttggcagacgcccatgttcttcggaaaaaggggtgtgatgtttcctcttatatgcagccgtgttcttgacagcagcctcaatgtcaattcttcttcgtaaacgccgggcatttccacaatgacaaatgtgtgctgttcatcctgataaatatcataagtcagggtgtttttttgtaaggagaaaaaatcttcgggagatttccgtttcaggacattggtccaaaagtcgctgggcttgtgctcgttcgtaatctcaagccactttctcattttttcgatatccacctcggcagaacctccctatatttgatttgcgatcggcattgaagggttggcgatctgatcctgatcgctcacgtcagggtcaagatggcccgaattcaaacatccggcggccggcgaaaaatcccctaaagaaaagttcgcgccgacaaatttgctgttggcggtgtggctgttttgtacggtctgaccgatatcgacgtttccgttttgcgttgctccgtttacttttatattgacgacgttaatttggtaaggcattcataaaaacccctttaatctataatgggcggcaccggcgtaatatttgcggtatctgcggttccgatggctgtctggtcgttgacatcaggatcatttaacaagttctccatcatcgattctataggtgacgtatcgccgaatgaagagttcagtccttgtgatttgttatttgtggtgggactgttgtatgccgcttccccaatcgtaatagatccgttgccagaaatactgttaatcttcaaatagtacaggttgataacagtggatggcatctcttcacacctctttaacttagttgtacagtactgtatgctttttgtgctcctgttgtgaatttcgcccggacatgttcccgaccaaacaagaagtcaaggcccggttccggcggggctttttttgtttcagggtctttcgcagtatatttgtgatgaaagcgctataaaaatagattgacgacatgtatatacatcattacaatagagtcgtaaacatgtatatacaagtttttttgagacaaaatgaaaacggttacggaggggttggcatgggtgagtttaaccgggctgcgcggcagatcgctgaagctgtcggcggaattgaaaatattgaggcggcgactcattgtgtgacgcgtttgcggtttgcattaatagatgaaaccaaggtaaaccaaaaaatgcttgatgcaatagacattgtcaaaggatcttttgcggtaaacgggcagtttcaagtcgtgatcgggcaggggacggtcaacaaagtatatgcggaattagtgaaggaaacggggatgggtgaagcgtccaaggatgacgtgaagaaggcggcagcgcaaaaaatgaatcctttgcagcgtgctgtgaaaacgcttgcggacatctttattccgatcttgccggcgatcgttacggccgggcttttaatgggtctgaacaatatcttaacggcggaaggcattttctacagcacgaaatcgattgtccaagtgtatccgcaatgggcggatcttgccaatatgattaatctgatcgcagggacggccttcgcttttctgccggctttaatcggctggtcggcagtgaagcggttcggaggaagcccgcttttgggcatcgtgctcgggctgatgctggtgcatcctgatctgttaaacgcatggggctacggggccgccgagcagagcggcgatattccggtgtggaacctgttcggccttgaggtgcagaaagtcgggtatcaaggtcaggtgcttccgattctgctggcgtcttatttacttgccaggcttgagctctttttgacgaaacggacgccggagggcattcagctgttggtcgtcgcgccggtgacgcttttggtcatcggttttctatcctttgttatcatcggtccgatcacctttgcgatcggtaacgcgctgacggcgggattgattgccgttttcggccaattctccgccatcggaggcctgctgtacggagggctgtattcggcgcttgtgatcacggggatgcatcatacgtttctcgcggtcgatcttcaattaatcggatcaaagctcggcggcacatttttatggccgatgctcgcattgtcaaatatcgctcaaggatcggcggctctggccatgatgctgattacaaaagataaaaaacagcgggggctttcactgacggccggcatttccgcatatttgggcattacagagccggcgattttcggcgtgaatctgcgttacaaatttccgtttgtgatcgccatgatcagttcggggatcgcggggatgttcatctccgtcaaaggcgttctcgcaagctcggtcggagtcggcggcgtgccggggatcttctccattatgagccggtactggggtccgtttgcgatcggaatgctgatcgtgctgattctcccgtttgcgggaacatacgggtatgcgcggctgaaacggcaaaaatagaaaaactgcggggcgccttctaacaggctgtcccttttccctttcaattcaaaacaatacaggcggtgaagaaaaatgaaaacagacagcacaccatggtggaaaaaggcagcggtatatcaaatttatccgaagagctttaatgatacgacgggaaacgggatcggtgatctgaacggtattatcgagaagcttgattatttgcagaagcttttgattgatgtcatttggcttacgccgatttacgattcgccgcagaatgacaacggttatgacattcgcgattactgcaccatttatgaagaatacggaacgatggaggattttgaacgccttcttgatgaagcgcacaaaagaggaatcaaggtcgtcatggatcttgtcgtaaaccatacatcagtcgagcatcagtggttcaaagaagcggtttcgtcacccgacagtccgtatcgggatttttacatttggaaagacggaaaggaagacggccgggcgccgaacaactgggaatcaaaattcggcggttccgcttgggagctcgacccggcgtcaggccagcactatctgcatttattcgatgtgtcgcaggccgatttgaactgggaaaatgaagagatgagaaaacaggtttacgacatgatgcatttttggttccgaaaagggatcgacggcttccggctggatgtgatcaacctcatttctaaagaccaatcgtttcctgatgccgaggatggccgtgacgggcgcccttattatacggacgggccgcgcgtgcacgaatttcttcatgagatgaaccgggaagtgttttcgaaatatgacagcatgacggtcggtgaaatgtcttcgacaacggctgaccactgcatccggtacacaaaccctgaaaataaagaactcgatatgacctttaactttcatcatttaaaagtggattatccgaatggtgaaaaatgggcactcgctccgtttgattttctgaagctgaaacggattttagcgttttggcagacggagatgcaaaacggcggaggctggaacgcattattctggtgcaaccatgaccagccgcgggccgtatccagatacggagacgatggcgtataccggacgaaatcagccaaaatgctggcggcggccattcatatgatgcagggcacgccttacatttatcaaggtgaggagatcggcatgggcaatccgaagttcgatgacatcggctcataccgcgatgtcgaatcactgaacatttacaaaaagatgaaggaagaaggcgtgtcagaaaaagacattatcgccattttaaaagagaaatcaagagacaatgcaagaacccccgttcaatggaacagcggaccgcacggcggcttcacgacgggaacgccttggattccggcggcggatgattatcgggacattaacgcggaagcggctttgcgggacccggattcaattttctaccattatcagaagctcatcaagctcagaaaggaatatgacatcgtgactgaaggaacgtttgagctgcttgctgaagatgatccggcggttctggcgtacgtcagacacggcaaggatgaaaaacttctgtgcatcaacaacttctacgggaaagaagcggactttacggttccgcttaaagacacggacggctggcggtttacggtgctgctgacgaatgatgaaccgagggaagggcggccggaacgattgacgctccgtccgtatgaatcgatcgtttatcatctgacaaaagcgtgatacactaatctgggtggtcatgaatgaaagtgaataaatatatcacaatctataaagatatggtgcggcagattgaaagcggccagcggaaggctgaagacgttcttccgtctgaaaatgatttgtgcgatcaatacggcacatcacgagaaaccgtccgtaaagcgctcaatatgctggcgcaaaacggctacatccagaaaatcaaaggcaaaggctccgtcatattagacagagaaaaaatgcgctttcccgtctcaggcctgatcagcttcaaagagctttcggaaacgctcggaaaagagacgagaacggaggttcaccgtctcgggctgatcctgcctccctcagaagccgcaaaagagcttggtacagaagcggatgaaaaggtgtgggaagtcgtcagatcaagacggattgacggagaacatattattttggacaaggattattttgtgaaaaaacatgtgcctcaattgacgaaggcgatttgcgaagattcgatctatgagtatctcgaaggagagctcggcctgtccatcagctacgcgcaaaaggaaattgtcgtggagccggcgggggaggaagaccggaagtatttggatctcagcgggttcagccatatggcggtcgtgaaaaaccgcgtctttttggaggataccagactcttccaatatacggaaagccggcacaggctcgataaattccgtttcgtcgactttgcgagaagagaaaaataaaaacggactgccgcggcagcccgtttttttgtcagtatcaaaatgaatactatccaacaaaaatgtgcgtactggtactttcaaaaataatggctacaatagtacataacgagatgaaaaggagagatcatgaatgtcagataaaaaacagcagatcatcgaagcgtatcaattcagacacgccacaaaggaatttgatcctgagaaaaaaatttcagaaagcgattttgaattcattttagaaacgggaagattatccccaagctcactcggtttggagccttggaaatttgtcgtcgttcaaaatccggagcttcgtgaaaaactccgcgagttcacatggggggcgcaaaagcagctgccgaccgcaagccatttcgtacttctgcttgcccggacggcaaaggatatccgttttgacgccgattatgtcaaaaatcacttgcgggaagtcaaaaaaatgccggaagatatgtatgaaggctatatcagcaaaacggaagaattccagaaaaatgatttcaatctgcttgaatcagatcgcgcgctgtttgactgggcatccaaacagacttacatcgccctcggcaatatgatgacagccgctgcgcagatcggcatcgattcctgtcctgttgaaggcttcaactataaagaaatccaccggattcttgaagaagaagggcttctggaaaacggaagtttcgacatctctgtcatggccgcattcggctaccgtgtcagagaaccgcgcccgaaaacaagatctgcctcaaaagacgttgtaaagtgggtataagataaaaaaagctgccgggcgtgtcccggcagcttttactgtttatttggttttgctaaaaaacaggcggtgatccaggacgtaacgggaatgatgatgccgatcccgattccggcgcaaagaatggtgacggcttccgcactgaatacttttgagttcactattttttcagctgagtatgataagtctttaaaccagataattaaagccaaatagctgccgaaaaaagcaaagaataacgtattcgtattcgttcctaaaatatctctcccgatgcttaatccgaatgtgtacagttcttttctgctcatggacggattatgactgtaaatttcccgcatgggtgaagtaatggaaatcgcgacatcggtaatcgccccaatcgtgcccatgatgatcatagctgcggtaacctttacaaaatccaccccgacaaacagtgtgaatatgccgatatcccccaattcttcttcaccgaatccctgaatcgaagtatgttttgttacggccataataaaaaacagcagcaatgcaatggtcagcattgcagaaataaaggcggttacggttttgacgtttcctccattaatataaaaaagagtaatgctgcaaatcacggcggaagagagcaatgttaaaacaatcggattgatatgcgggtctgtcatgaaaataatggtgagaaagagaacaccgaaatttaagaataacgcaataaaagacctcgctcctttttttccgccgatgatgaccattaatagaaataaaatcgccgcgagaattacgatgacattcatgagcttgccttctttcgtttaataaaaaagacagaagcatacagactggcgggtatggttaatacaattccgatccccccggccaatgctctggctatttccaaggaaatgttcatagaaagagtgaatcctatcggggaatcatttttcaaatacaaaagcatcatcggaatagagccgcttatataagcaaaaaacagaatgttggtcatcgcccccatgatgtcttttccgatctccatcccggaacgtctgagagcttgtaatgagatacccttgttttcttcatataatccgaagacagatgacgtcatggtaatggccacatccatgaccgctcccagtgatccgataaataccccggccataaacaccgtgtgataagggcgggttaaatactgcatttcctcatatctgagacctttctctccggttgccagcattaccagatacgtaatcagcagggaaacgaacgtgcctgcgagtgtcgcggctatggcggcgtatgttttcgcgtgaaaaccgctgacaagcagcaatgagatgacagtaaagatgagaatacagataccgcagatgaaaattaaccctatattaggatgcttcctgtacaaatctaatgcaaacgacagtaaaacggcattaaacatcaggctgacgatcgaaaagaagccttgttttttgccgacgataagcaaggtgaagatgaaaacccaagcgatcagcaaaatctgtttatcccgttttttatctataatgcttcccgatatatctttgtttgatggtttccctttatcaatagaaacgaatacttcatcgccaatcgaatatttctgatcattcgctccggataaagaatactgattggacaaatgaatgagctgtcctttctgacttccgttttcaagtctggctgtgatcgtctgagtgaaaatcttatctttgtttttatgcatgtcctgtacgtcagactgatgttccaatgttgttttcgtcactttggcaatcggccgctcataaaaagaagcgttgtgagtgacaaaaatgagcgagctgataaaacaaagcgctgttatcacgtaaaacagctttttcttgtaagacatgcggtttcgtttgtttcctgtaatcttcaaaaaaagtcctccaaacaggcggcgccgtgtgaaagagaggccctgccgtgaagtgttaaacgatgcggatgcagtctttcgcgaataacgttcatattttatcactcggccatacggctgtcgactcagaggggggaccggcagaaaaagctctcctgatatcagatcaggagagcttttgggatgaaccgcccgataaaagcggtatttttatgcttcgttcactttttttgcttttcttctttggtacagatacagtgccgttccgagcgcgctgatgagtaacccggcaagaaggatggaatacatcgttgtggccgtatcaggaagcaggccgcccggcgatactccgtcctgcgcagggccggatgacggtttttgtccgcttggctgctttccggagccatgatcgccgcttgtcggcggcgcgctcttcgtgtttgcgtttaatatggtgtattcactgaaatgatttgtatagcccgtgacgagatcgtgtgaaaccgaaccgttgtctgtttttgtatagacgttctttttccggtctacatgataaatgccgggctgtttcgcctttttcatattctcaatgcgcagggtgagctttaccggcgcattgaatgttttgatgtctttgtttttctgcttcattgtaaagtcgtatacatttgaaagcgccccgctaacttttcctttcggcgtcacaccgaatcgtgtatcagctgaagcagcgtttgccatcggcattttcatgttgaacttgtcatgcaggatcgtaagggaagaatccgatgttctgtcctttaacaggccgatttgttttttggtcacgctgagatcaatcggctttttggcgccgtcattcttatcgtaatacacgatcggcgtgttggcgtttttggcatagacggcaaatgcgctgtcatcttcaagcgtccacgaatcgtttttttgtctcgtcggcaggtacacttcctgcgcgcggccgtcaactttcggttccaccgcttttcccgctttttcaagctgctcaacgaagacctcatagtcggcaaagccaaggtcttctttatgggacgcttcgttaaagacggaatatccgtctccgccttcaccgacaaagttactggtggcgactctgtatgtcttcttatcagaaatcggctttacactgccgtcatcctgtacggtcgcagcttgaagaacgcggtgtcccggctttttattcagtgtaaacgtgtatgttaaaccggcaacttgagggaaggcgccgccttgagcttcaattccgcttaatccttgttccagggcttgtttgatctgttttccggttaaatccgcgacgtaaagcgtgttgccgaacggcattacattcagcacgtcgccgagtgtgatgtctcctttatcaatgcccgcgcggatgccgcccccgtttgtgatcgcgatttgggcgccggccgcttccttcgctttttgcagcatgccgtccgcgatgaagtttccgagattggtttctttggagcggacatgctcgcgctggccgtcaagtgcgaccttcgttgaaccgactttttcatttttaactgagacgagctcttttttaaacggatcaagctcttttttcagatccgggtcttctttcgtctgctcattcaccggtagcgcttgaagagaggattgttccggcaggacgacgccgtttttgtcaaatgcgacatcgacacggcctaaatattcgccgtattcttttgcctgggcgacgatggtcggctcttcgtttttgacaatttccattttatctacaagcgtatgcgtatgtccgccgacgattaagtcgatgccttttacctttttggcgagatcgagatcacgctgatgcccgatatgggtcagggcgataattttattgacatgttccttgttctgtatttcttttaccgtatcttgtgcggattggaaggcatcatgaaagacaatgctttttcccgggcttgatgtgacggacgtatcttctgtcgtcaagccgaatacggcgactttttctccgtttacatcaagcagaatatatggatagatgcctgcttttttctttttccctgccgtaaatgtgtctgcttttttcatgaatggtctcagttttgactctttggccacatcgacatttgaactgacgagcggaaagtcaggcgcttgaaaattgtatttcccggatgggtcagacgcgctcccgttaccgctcaggaagctggcgagagcacccggacctttatcaaactcatgatttccgaaggtcattgcgtcgtagcccatgctgttcatcaattttaaatcagccagcccctgccactttgtgaaatagagatcgcctgagaaaacgtctcccgcatccagcaaaatgctgcggtcggtttcgcttctgatttctttaattttcgtcatccgcctcgccgcgttatcaaggtgggcgtgcgtgtcatttgtatgcataacggtgagtttccatgcgtcatctttcggcggatctgtgcccggttcatcatctttgaattggagcttgtactgtccgtagcccgcgttttgtgattcaccgatataggcgacgtcatctgcgcggtcggcaaacggctttgcggccaaggaagattcaaatgtcaggtttgtccctttgaccggaaggatggaccagttatgatcagcctgcggattaatcgttttctgctggatgatgtaatccattaagacctgcctgttctcatcggcagaagagtatacgattttatcattgcttaagtgagggaatcctccgccgcctgaagcgcggtaattatttgtgacgatcagaaattcctgcttggcgctgacgggctttccttgataagaaaggttgacgatccggcttgcatcgggatgaatgactgttccgttttcgttgtatttcgccggttttgtgacatcgacctgataggtgacaccgtcaatgacatcaaaattgtatgagcggtaggcgtcatttaaaagcgcttggctgccgccttttgcctgatcgatctgattaaattgccccgcggacatttcgagccagtctttcacttcgcttccgttcagcttgacgatctgaaccgtgttgtcatacaggtacaaatcgccgatgtttttgatggcgaggtcgcccgcggaaatgtttgtatagtagtttgagccgttccgcccgccggctttaaacggggcgcccgccgagaggataggcagatctttgtactccgtatccttcatcttattttcagcgtaccatttttgcgcatccgttacgatttgaatggacggatcatctttgacttgggcgaagaaactgttgatatcggcttttgtctggccgacgggttctctgatgtatttcaaagtgccttcgtgcgcttttttgacggtattgacgacggtttcgttttccgaattcacattgccggcaatcggctcgatgctgccttttgcatcttccacatgccacgcgctgtctgttttttcaagccggaggtcgatgacgcccgcatatttgccccagctgcttgacataacaacggggatgccgttaatcgtgcctttatcgacgtcgaattgagcagcgcctttgtattcggcatcagggaaaagcccgtgctgatggccggatacgatcgcgtcaattccgctgactttcgttgccaggtcaaaaacggcgttttccgctccggaagactgcgcttttttttcgatgccgctgtgggcgagggcgatgacgatatcggctccttcagctttcattttcggaacggttttctttgcggattccacaatgtcctcgacctgaacgcggccttcgagatttttcttatcccacgtcatgatctgaggaggaacaaagccgatgtagccgacttttagctgatgcttgccgccgttttcatccgtgacggttttgtcttttatgacataaggcgtataacggttttcgccgcttactgttttcacattagcattaacgatcggataatcagcgcctttgattgtcccgtccaggaattcaagcccgtaattaaattcatgattgccgagtgttcctgcgtcataatgcagactgttcatcacttcaatgatcggatgggtctttgcgcctgaaatgatatcatttttctcatattttacggcgtattctccgaggggattcccctgaatcaggtctccgttatcgacaagcactgtattcgggttttcgcgcctgtgcttctcaataagctgagccgttcgggccagcccgaattccgttgtcggtttgtcgctgtagtaatcgtagtccatcatgttagcgtgaacgtcagttgtggctaaaatgctgagattcacactggaggatttgttttcttctgctttaatgggtgatgttgggaggatcagactaagtatcataactaggggcagcagaatacggagtgtcatattgacgctgcatcgtcttttctgtattctcacctgttctccacctttcaacaaattttgtcatgcagtaccattgtaagaatattttgtgaaagtttatatagatttcatgatgattcttgtgaaaagataaaaaatgaggataatgacctatgtaaaacaggcgggcggtaaacgcgttacctatgtttgatgttagtgtggctggggtacatggatttatgtagacttcatcaagcaggaggtagtaactatgggtaaaaaaattgcagttgtattaacggattactttgaggatgtcgagtatactgaacctgcgaaagcttttaaagatgcgggtcatgaattaaccgtaattgaacaggaaaaaggaaaaacagtcaaaggaaaacaaggggaagcggaagtgaaagtggacgcgtccatcgatgatgtgaatccgaaagactttgacgcattgctgatcccgggcggattctcacctgacatgctgcgtgcggatgaccgtttcgtccaatttgccaaagcgtttatggatgataaaaaaccggtgttcgccatctgccacggccctcagcttctcatcaacgcgaaagcattggacgggcgcaaagcgacaggatttacttcaatccgaatcgatatggaaaacgcgggcgcgaatgtggtggatgaagaagtcgtcgtctgccagaaccagctggtcacaagccgcacaccggatgacattccggcattcaaccgcgaatcattaaaactgcttgcgtaatataaaagcggagcgccgtatcaggcgttccgctttttttgtgaagattcccggatgaccagctcaggcgccagaataatgcgctgttttttgtgctgggaattggtgattttatgatgcagcaattgagccgcttcttttcccgactgccgcggaaaggaagaaacggttgtaagcgggggataagaaatttcagcttccggcacgttatcaaagccgacaatgtcaatatcttcgcccggaacgagcccggcttttctgatcccttgcatgacgccgaacgcgaccaaatcactgaagcagaaaatcgcggtcgggtgctcagaccggcggaggagctccgtcacggcctcacagcctgcttcgcgggtcggcgcgctgtcaatgacatattcatttttcacttccagacccgcttcacggagcgcttttttaaaccctttcatacgcttcgtccatgttgatgagtgcttcacgccgcccagaaacgcaatctcctgatggcctttctcaatgaaatgacgcactgccttataagtgccttcttcataatcggctccgacaaaatcacagtctgcatcggcaatctccctgacggcgagcacgaccggaatgtcaagctgctcaaggcgggaaagggtttcctcagccgcacctgaaaccggacacaaaatcaatccgccgaccctgtgctccagcatggtcgaaatcagctgctcctgcttggcgacggaatcaaatgtcgtgcctaacagcaccgttaatccgacttcctcaagcgtattctgaacgccgatcagaaactctgagaaaaatgtattggaaatgtcagtgataatcaatcctaccgttgtggacgtctgtgatcgtaaattcgcggcgacccgatcatatacgtaccccagctcccgcatggattgcagcactttctcacgggttgcttcggaaattcgggggttgttgcggacaattaatgaagcggtggatgttgagacgccggcatgttcggcgacctgctgcaatgtcacccggcgttttttttgctgtttcatacgtcgcattcctcacttggtttttattcgttacatccattataagcgttttggcgcatgagaagaaagagagaggagggggaaaaagataaagcgccggaagacggattgtccttcggcgcttctgtcacataggttattcaaacatttgctctttaatatactgaaccggcatttcacggcctgtccaatattcaaatgccatggcgccctgccaaagcatcatgccgagaccgttaatggttttgcagccggccgcttgagcttgttcaagcaatttcgacgtaacggggttgtaaacgacgtctgtcacaatcaaatccggacggagcatggatgtatcttcaataacgctcaagccttcaagcggtttcatgccgacacctgttccgtttgtgaaaatatcgcttgaagcgatttcagcacgcagcgcatcttgatcttcgagcgggaagactttcgctttacaagaagatcccttcatttcttcattgatgatgcggacattttcttccgctttttcgaaaaacgcgtcattgcgggcgaaaatagagatttctccgaggccttccaatgcggattgaatcgctatcggagtggcggccccgccggaaccgaccagcgtcatttttttccctgtgatatcgatgccgtgttcttttaagttgcggacgtatcccataccgtcagtggagtgtccgatcagtctgccgttttcattaacgactgtatttaccgcgccggtgaatttcgctgaatccgcgagttcatcgagataagggagaatgttcatcttgttcggcatcgagacattgaagcctctgacgtttaaggcacgcattcccgttaccacatcttccagctgttcattgccgacttcaaacgcgaggtaagcgtagttcaatcctaattttttaaacgccaggttgtgcatcgccggagataaagagtgtccgatcggtgtcgcgaataatccgataagctgagtttttccgttaatccgtcctaattctttcttcatgatgtattcctccgttagtccattcatttgtttttcaacccgctttgagggcaaaaaacgctgattacatatgtttatttaaaatgctgagtacgctgcgcaattcctcaacgggaatctgcccgggcgctgatgcttctttgcccgcgccgaacgtgcacgctgagccgaagacttcgccggccaggcggctgatcaggcctgttcccgccattgacatcgtgatgatcggccggtccgcgtattgtgttttcatcgtgtgagtggcatccaataagacgaaaacatcttccgtgctttgcggcatcaccgcgattttcggaatgtgcgcgccgtacgcctgcatgttccgcagccgggaaatgatttcttcttttttcggtgtctgatgaaaatcatgattggacatgacgacatatacgccgttgtcttcagcggttttcacaattgatttgacttccgcttctcccgtaaacagctcaacgtctgcaaggtcaatatgttttgtttcgatggcggttttaagcaattcaatgtaaaagcggtcatcaataactttatttccgccttctttatgggttctgaatgtgaaaagcagcggtgttgcgcctgcggctttccgcagcttttcaagcatgccttttacggcgtccaggctgtcaacatgctcgtatacatccgcccgccactcaatgatatccgggcgaagcccgttgacggcttcaatttcttcgagcagttctttctctccggccgccatcagcggcacaatgatcttcggaagcccttcgccgatgaccgtatttctgatcgtgatagattgcatgataaatcctctcccttaaaaaatagtcaggctttcatcacttgcttaaagcggattccgataaacaatgcgagaagggcgctgacggccgcaattccgatatcaagcagaaaaacaggcgtcaggccggcggctttggatatcgctcccgttacaagcggaatgacaataaaagataagcttgatgctatattaacaaaagatgtgatcgtacctttatttttagggaataaaacagccataaccgtcatcgccaattgcagaatgcccgcagttgaaagtccgatgacaaaggagctgatgaccgatacggccggctgatgaatgaaaatcagagcaagcagcgcaattgccgcgatcacagggtacagcaccattaccgtaatcggctgaatcactctgtttaacagcacagccagcaataacacggacacaagcgccccgatactgtaatagctcaacaatttgacggcctgcacctcaggcatgcccaaaacggattgcccgaacttaggaagccatacttgaacgagcataaacagcgccgttgatgaaaagcctaacagaatgattgcgaggccttcgcgccatatcgacggctgtgatgtgaacgcgtcatcagacggagaggcttccgtccggccgccgtcttctttttgcttatgattcggaaacggaactttcaacaggaaaaagccgttcaggaagaaaataatgcccggtacgaaaaacgtccagccgtaaaacaaatgcctgtccgcaataaacgcgataaaaaacggaagcaccgtcgcgccgattgatacaaatgctttgattaacacggttgcagagcttgcgtttttcggaaatccttcaataagcgccggatatgtcccggaatccaaaaaggaattggcgatcccggcgaaaatggcgaagataaacgcggccgtatagtttgtcgaaagcggaatcccgattaggaaaatcagatacagaaaggcgcccgacacgataaacggccgtctcccgaatgtatccgaaagcttcccggcaaacagaagcgaaatcagcttcccgatcccgatggcggagaccaaatagctgacaccggctgcggaagtatgaagctgttttgataatgcctccatattggatgcgataataatattgatcatgcccagcaggaaatagttaatataaagacccgctgccattttggtgtatatgtttttcatgatgacatcccctaatgcggttaataaagaattaaattatttttttaattgataaaagcacagcaccattcccctttattgaaccactgcctttctttgaaaactgtttgaaacaacggttgcatagacaaacttgaataacgctgatatcacaatgagtatatcgttctactaaataaaaaaagataagcggcctgctcatttagtatatcgttctaccaagttcacagttactatactccttctttttatatgtgtcaaaccgatgaacttttattttttgcttttttaaatcaagaaaagacctgccgtttttcggcaggtctgacatgggtttattttctgagagaagcgagctcctcggcaatggcctgcatttcactcgggctgaatgatgcttttttcatgaccatttgatgaaggtatgtaagatcttctattttttcatcactgaaatcttccgctctgatgacgccgacattgagcatgttgagcttttgcgaaatgtcttcaatcattttgtttaacgtttctgtttgttggctcggcaaattcatgcatcctttcatgaccgttttcgtaccctttattctaacagaattcatttagaataaaagcttatttccacagccgcagaaaagttgctaagatgttgataaggtttttgatcctcaaaatgcggggaaagaatagggaggttatcgatatgatacatgtgctgtttgtctgtctgggaaatatttgccggtcgcctatggcagaggcggtattttctgatatggtgaagaaaaacgggctgaacgggcagattaacattgattcagcgggaatcggcgcctggcatgcgggaaatccgccgcatgaagggacaaaggagatcctggagaagaaagggatcagcgcaagcggcatcacggcgaggcaggtccgtgagtctgatctgaccgattttgattacgtcattgcgatggatgcagaaaatatcggacatttgcgcagcatggccggttataaaaaagcggcgccgcgtattgcaaggctgcttgattatgtaccggagtcggaccttgccgacgtgcccgatccgtattataccggaaatttcagcgaggtgtacgctttggtcgagtccgggtgccgtcatttgctggagataataaagaaagaccatcatttataagggggattgaccgatgaagcagacacgcatcatggcaaaagcgattctgatcggcgctgccgccggcggagcactgtccttattacataagccgacgagagaggcatgtttccggaatatggacgcgtgcaggcggcgtgcggcattttaccgaaaacatcctgaagccctgaaacagcaggcttccgcaaaactggatcaagtgaaaatcatcgccaataccgtatcggacgatctgagttttttaaacgggcagatcaccaagctgaagcagacgacaccgcaggtcattgacctgttaaaagaaacgaaggagcatttttcgaaaaacgatcattgaggtgggatgtcatgagttttataaaggagctgtttgcaaggttttctctgcatgaaggacaaagtaaatcggcggagctggcgtattttttcctgctgtcattgtttccgttaatgattttcatgctgacgctcaccgcctatcttcccatatcggcagaagacgtgctcggggcggtcgatcaatacgcgcccgacagcgccatgtccatggtgaaatccataacggagcaaacgctgaacaagcgcagcggcgggcttttgtcattcgggattatcgccgtcatctggtcggcttcgaatggtatgaacgcgattgtcagagcatttaaccatgcctacgaagtcgaggaaaaccgctcatttatcatcattcgcctgacctcaatttttttaaccattgcgatggtggttacgattttaatcgcattgcttctgccggtgttcggcagagaaatcggaatgctggccgcggattttatcggcgcctcggacctgtttttgcaggtgtggtcggttgtccgctggggtatcagtccgcttatcctgttaatcgtgtttaccgcgctttacattttcgcgccgaataaaaagctttccctccgttttgtgctgccgggagccgtattcgcggcagccggctggattatcgtcagtatgctgttctcattttacgtcggcacctttgccaactacagcgccacatacgggagcatcgggggaattatcgtccttatgatctggttttaccttacgggaaccctgttgattttaggaggagaaatcaacgcgcttttacataaacgtaaaaagcttcctgatgaaaatccgtaccgcgggagcaagctatagaggaacggatgacgttcaagctgaaaaacggagggaatcggctatgaccaagcatacgaaaaaaggcggaagccataataaacaaaactcaaaaaacggcccgaagaataaaacaagcggaagcgccaacgggcagaacggataccactagaaagaagccgcctggctcagatcaggcggcttttttatgtggccggaaaagaatgggattcggaagcggggctgtgctttgttttcccgaagacgagcgcaagccaaatacagaccagaatcaccgtaataaagtaaaacaagttggcgctttcaaaccgctgcatataccagccgcccgccaccgggccgatcatgcttccgagactgaaggaaatgccgcagagcaggttgcccgccggcagcagatgggacggcagcaggtcgctcatatagctgatgccgagggaaaacatactgccgaccgccatccccgccgtgaaaaagcagcagccgatgacagaaggcgacggaaacagtccggccgtcaaaaagcaaagggcacccgttaataagatgacgagcaggacacgttttctcccgaatcgatcgcttaataaaccgagagggaactggaatacaatacctccgatggcaaaagcgggcaagatcagcgcgacggcatcaacggatatacctaaacgaagggcgtacacgggaaagcttccgttcagcgccgtttctaaaaaaccgtacccgaaagccgggagaaaagcgacccagccgaaaagaagggcgcggtaaaaccgttttgcgctgttgtccccggatgtttcatccggaccttgcgccgggtactcgttacgtaaggcaaacacaaacagccaggcacaaagactgatacagccggatacgataaacggaagggacggacttgttttcacaagagggaccatgaaagggccgacagcgaatccgagcccgaaggacagtccgtacagcgaaatgtttcttcctctgtttcggggcgttgacttggaagtcacccacgtttgggttgaaaaatgcagcatatgatccccgattccgataagcagccgaagaaaaaaccataaccatatggattgaagccaaataaaactgaataagctgatgataacaagaaatccgcccatgaccatcagaggtttgaatccgagcttgcgcagcggggcctccataaacggcgacgccagaagcacgccgatataaaggccggttgcgtgaagtccgtttatggctgcggattctccgttcgtttcaaaaatgacggagatcaccggcagcagcatgccttgggaaaatccggagatggaaacaagcagaaccaaaataaagaagtacagtcgtgacatcgcgtatttctccttcttcagtatctttcttgatcgtacacggattttccgcgtccggcaacctgaaaatgccaattcgggctgccgaggaagtgtaattgagggagtttttgagaaggatataaaaagacttattcgaaaaaaggagccaggcagatatgaatcggatttttttctttacggctgcggcgggagttccgctttcagtcatcggcggcctgatgcactggccgtcagcggttttgtttattatttattgcttgacgattattgcgcttgcaagttatatggggagagcgactgaatctcttgccattatcgcgggaccgcggatcggcggtctgctgaatgccacgttcggtaatgcggtagagctgattatatcgctttttgccctaaaagaagggctgacgggcatcgttcttgcttcactgaccggttcggtgctcggcaatcttttgctcgtcgcgggactgtcgttttttatcggcggtttgaaatataagcggcaggaattcaatattcatgatgcacggcataattcaggcctgctgatttttgccattatcgtagcttttgtcattcccgaagtattttccatggatatgggggaaaaaaacaagctaaatttgagtgtcggcatcagcatcatcatgatccttttgtacgtggcagctctttatttcaagctcgtcacccaccgcggtgtttatcagccgaatcagccggaggcaaaggaagaagaggagcagcctgagtggtcggggaaaagagcgacagccgtcttatttatttcaactattattgtcgcctacatatctgaaaaccttgtccatacgtttcatgcggtggctgaacagttcggctggagcgagctgtttatcggggtgattatcgtcgcaattgtcggaaatgccgcagagcatgcgtcggcgattattatggcgtacaaagacaagatggatgtcgccgttgaaatcgcggtaggttcgactttgcagatcgccatgtttgtagccccggttcttgtgatctgttctatcttttttccggtcaatatgccgcttgtattcacattgcccgagcttgtggcgatgatatcatccgtccttttgatgacgatgatttcaaatgacggcgattcgaactggtttgaaggggctacgctccttgccgcttatgtcatcatggcgatcggttttttcctgctttaacctgtaaaaaatgcggataacaacgattgcggaggaaaagactaaaggaaaatgctatagaaagagtgatatgatgagaaagctgtttcatgccacattgattctgctgttatcctttagttttttcgcaatgccgtctgccggtgcaaagaaaccgtttaaggttcccaactctgtcgtaagcatttcaaaggaaaatacgtatccgaatgcttcacaggaccagccgatgcttcagccgagcaaactggcaaaggaattgttagatacctccgagatcaacatcgaaaatccgcatctgataaagatgctgaatgaatcctcggtttccggttcaccgcttgccatcggatatcgggcgacaatatttctcgggaaatgggcgctcggctatcaatcgaacgaaacggtcgccaactgggaatataaaaaaattaacacaaacagagcggataaccggggcggacagcaaaccgcggttatctcatatgcccaagaacagcaatacaaaatcaaaggcgggctcacagcgaaggtgccgaacgcagaagacgtaaaaagtatgatgatgcaaaaagcgatgaagaaaacaaaactgccgctcgcttttgaaacggttatcggcgcaggcacaaaacgcgatcaaacctacaaaatttctccgcagcggctcggctacctgcacgcctacgctccggccgttaatgaaaaaggaaaagtaacatacggtgaagtgtatttggtgctgaaaggcagcaagcggaaacttgtcgtcaaaaatgtgacttcgcaaggaatcggggcttggattccggtacaggatcacgtcacattcggttttcaaatgacagcgcagccgagataactaaaaaagctgattccggttcgggaatcagcttttttgtgtgtgatacatttcctcaagcaattgcacattgttgttgtacagctcccgggcaagaacgcgtctcaccgcaaggctcgccgagaagtattctttatcttgaaccatgcctttgacggtaaattctatgcctctcgtcaatttgttcaggctcatgattccatgcacttgaaacggctccgtcgcattgagaaattcatctcgcttcagtgaatcgcgaagctcatcattgagcatgtcgcaggctttttctaagacggcatatacccgctcgggatcttctttataactgatcacgacggactcggtaatccgcataaaatcaatgttatagttttgaagctgtctgacctcaccgtttgaaatggtaagcagcttgccggtccactcacggatctgaagggaacggagcccgatttcttcgactgtgccgttgaacagattgttaatcgtcacgtaatcgcctttatgaagctggcgttcgtatatcaaaaagacaccggccaatatgtccttgattaacgactgggcgccgaaaccgatgacgataccggcaacacccgccccggctaaaattcggccgaaatcatgaacgaataaagaaatgacgtaaaagataaaaccgatcgtcgccgtatactgggtgatggatcggacgaggctttcaatcgttttccctttccgttcctccaagaaatctatgcgtttaaataacacctggacaaagcggttgatcagaaaaacaccggcgtaaagcacgagagcgacgatgatgatctcaaccactttgcttttcaaaatgtccgtaattgtcgtttccatcttctgttaacctctggcttttcgtaatgaaaaatccgtgtcctgataataactgtttttgacaaggacgttcggtccgaggcaccggacgtttgtgcagcggcagttcagctctttgctcagcttcgtctgtctccacttgtcatatgcattgggaaggctgtctgttttaatattgccgagcggcggtgtatcgccgaaatccgtgacaatgatatttccgtcaaaaatgttcacattcaggcgggagcggccgtcagggtcgtttcgcaccgtaacgtatttcgcttcccgcaggcggcggaggagcttctggtcttcttcatcagggctgcatgcgtaaaacgggagcgtgccgaacagcatccatgtctcttcatcgcgaatgtcgagcagatgatgaatggcctgtctcatgtccttcaggctgagtgattcaagcgcgctggcgaaatcactcggatacatcggatggacttcgtgccgctggcatttcatttcttccgtaatctgccggtgaatatgttcaatatgcggcagcgtgcgtttgttcagcatcgtttccgctgaaaccattacgcctgcttcgaccagcgtgcggctgttttcaatcattttgtcaaaatagcgcgcccgctgttcaaatgtcggtttcttctccatcatcgcaaatccgatgtcggcaaagtcctcgaccgttccccagttgtgggaaatgtgaagaacgtccaaataaggaataatccgttcgtagcgcccgatatcaagcgtcaggtttgaattgatctgtgtgcgcacgccgcgttcatgcgcatatttcaaaagcgggacgacgtattcctttaccgatttcagcgaaagcatcggttcgccgcccgtaatgctgatagagcgcaacagaggaatttcatcaagccgctttaataaaaggtcaatcggcagcgcattcgggtctttcggctggagcgtgtacccgacggcgcagtgctcgcatctcatattgcacaaagtcgtcgttgtgaattcaacgttcgtcaatttcatatctccatactggtcgacatccatgtacgcttcccaaggatcgtactccggtgtgatcggacgcagtgttgtgttttgtgtcatgactatctaactcctttataaatggggcatactaacgtctgccaactgttaattttagacctgatctgccaagatcgcaagtagcggaaccattgaaaaacgccaaaaaatacgctaccattataaaaaatgaatggagtggaagtatggggaatgcagtaaacagcaaagatcagcagctcgattacctgaagaacagactcgatatgtttatgaatgtcattgattcattagaccctgaatcaacggacgttgaagatatagaccggctcattggcatgcttgatgatctggaagcaaaatacgaacgctttaaaaaggattgggaataacccccggcggatgccggggtttttctttttccataatgcggctgtataaaagggcagggcctactgcaaaataaggaaaaatgcagaaggagtgctggtcatgaaatggttttgttcaatttgctgcatggccgttttacttgcaggaggcatcaacagcgcagaagccgtgccgaatgaacggataaactggggatttaaacgcagcgtcaatcatcagccgccggatgccggcagacagctggacaatctggtcaaaaaatatgatgccttttatttgggcaatacgaaagaaaagaccatctatttaacgtttgataacggatatgaaaatgggtacacccccaaagtgcttgatgtgttaaaaaaacatcacatcacgggcactttttttgtcacgggtcattttgtgaaagagcagcctgatttgattaaacggatgtcaaaggaaggccatatcatcggcaatcattcttttcatcatcctgatctgacgacaaaaacgggcgatcagattcaagacgaactcgattccgtcacggaagctgtgtacaacattaccggaaagcgggacaacctgtatctccgtccgccgcgcggcgtattcagcgaatatgtcctcaaagaaacgaagcgtctcggctaccaaaccgttttctggtccgtcgcatttgtcgactggaaggttaacgagcaaaaagggaaaaaatacgcctatgatcacatgataaaacaggcgcatcccggcgcgatctaccttctccacactgtttcaaaggacaattcagaagctttggacgatgccattaccgatttgaaaaaagaaggctacacgtttaaaagcattgatgacctgatgtttgagaaagaaatgaagctgccgcgcctgtaaaaaacacctctcctggtaatggagaggtgttttgttatttgatacatttaatcaaagcggcccaatccagatccccgaagccttgtgcgaccccgctttcaaaatggctcttcgccagttcggcaagagggagttttgcggaaacctgttctgcggcggcgagcgccagattggtatccttcagccctaaagacattttgaagccggccggctcaaatttctcctcagccatgatcgtgccgtaattttgatagacgggagagccaaagagcgcaccggcgatttctaaaaattgtttttgttctaaaccgaacttttccatcattaagaatgattcagataacgcctccagcatagaaacgagcaagaaattgacgctgattttcgcggcattggccgtttttgtttcttcacccgtatcaaatacttgctgactcaggattttaagcagcggttcggcctttttcttcgcttcagccggtccggctgtgatgatgcgaagctcggccttctcggcggcatcggggcggccgaggacgggagcggcaataaaggactgccctctgcccgaatgtgcggcggaaagctgttctgacagcgccgtactgatcgtgctcattgaaatatgaatgccgttttcagataacccggcaataatgccgcaagctccgaacgtcacgcctgttacagcttcatcgtctgacagcattgaaagcacaatgtccgcatgttcagctgcctggcggggcgtttcggcatattcggcccctttatccagcaggtcagccgctttttctttcgtccggttatatacagtcaggctgtatccggctttcatgatattttcggcgatggggcggcccatattgccgagtccgacgatggcgatcttcatttgacagtccctccaatgaaaagttttccaccattatacatgcaaaatggttaatctgctgtgtacaggatttccaccttcagttcaggttctgaagaccatccggagtctgaggcggctttccccttataaaatccggtaaaccgcgtcttgatgattgttttcgaacggggctttacagtgaacgtttttgatttgaatgtgacgtcctttatgttttctgataaatccggcgtgacagaaatggtttgttccccttttccgtaatgattgatataaagcgtgcagctcatgcccgctctttttcgctcaatcagatgactgcattcgctgcggtgcttcaaatattcgacagactctttttcgggcgcgaactgttttaaggaaaaagcggcatattcggtggcaggactgataccggaagcggcccccatactgagaaagatcagaaacagccccgccgcgggaagcgtccgcctgaacgcggcggcacaccagattaacgccgcaaagtaaaggacgaccccgggaatgacggagatatgggctccgtcttccgaccaagaggaaaagccgagtaactcaaagatgtaatcagacaccgtacagccgttatacagcggggcaatggacatgacactgaatagcaggaggacagaagaaatgattttgtgagaaaagatggtaacggcgcacacctctttacgtttttttccagactatcatgttttctcaaaaaaaagaacagccggcagccgttcttacttgaaaatattaaaccagcctttgcgggcgaaccaaaacagcatggcggccacaagaacggccatgacgcccaaaacgataaaatacccgtatttccaatgaagctcaggcatgttatcgaaattcatgccgtaaacccccgcgatgaacgtcagcgggataaaaatggtcgagacgatggttaatgtcatcataatggcgttcatccggtttgaattcagcgtcacatagctgtcccgtaaatctgacgtcatatcacggtttgactcgatcagctcggccagttttaacaggtggtcataaatatcgctgaaatatgccttcgtttcacggctttcttttacatggtcaaggctcaaaatccggtacattaaatcgcgcatcggaatgatcgtccgtctcaggttcaaaagatccgtccgcaattcaaacacttcattcattaatgtgccgtaagatttatgggttctgctgtcttcaatttcattcagccggtcttcaattttgtacagcacggggaaatattcatcgacaagctgatccataatcatataagtgatgtgccccggcccttttttggctaatcccggggaagcgaaaaaccgttctctcacccttgagacgccgggcgattcgtgcaaatggaagctgacgatgaaacggtcggactgaaaaatgtccacctcttccatttccagtgtgtccgggttcaaggcgtggagcacataaaaacggtagccgtcataatggtcgattttcggccgctgcatgtgctgaaagcaatcctcgatcgcaagcggatgaaagtgaaaataatcccgcagcagctcggtttcatgcatctcagcgccgaaaaaatcaatccagtaccatgcgatgtccggttgttctgtacgtgatagggggatattatctaatatctcattatgtgttgtgattgcggttatatgtatcataaacaaccctccgcctgccattatatcatgcggcgttatgaagaaaagtatacgaattgccgcccggccgcttcatgatatacttggacaaaaaggggtggagcatatgtggaaggaaaccgtttcggtcacgccgccgtatcattttgataaagtccttgaaaggctgtcgctcgatccgctgaatgcggtcgatcttcatgcaagatcaatcaaagtgccgctcagaacacgggacggcaaactgtccgtcatcacggttcaagcggaaggcaccgccgcagacccggtcttcctcgtcagcggagaaacggaccgcgaggagatgattgaacggatcaaacacatttttcagtgggaacagccgcttcagcctgtgcttgatcatttctcaaaaacaaatctgtcggcgctttttgaggagcatgcgggaaccccgctcgtcttggaatatgacgtctacaactgtctcatgaaatgcatcatccaccagcagctcaacctgtctttcgcatttaccttaacggaacggttcgtccatgccttcggtgaacaaaaagacggcgtctggtgctatcccgaaccgaaaacgatcgcggcgcttgattatcaggacttgcgggagctccagttcagcatgagaaaagcggaatatgcgattgacatttcacgcatgattgcagacggagcgctcaatctggcggaacttacccatttatcggatgaagacattatgaaaaagctgatcaccatcagaggcatcggcccgtggaccgtccaaaacgtcctcatgttcggcctcggccgcccgaatctgtttcctttggcggatatcggcctgcaaaatgccatcaaacgccgcttcgcccttgaggataaaccgtcaaaagacgtgatgcttcaggtaagcagcgaatgggcgccgtatttaagctatgcgtccttgtatttgtggagaagtattgaatgaaaaaccgctttgaggatttttggaaacttccagtgaaaaacattaaggaaccgccggctgcatgttatactgaaaagatgtgatatttcaaatcagccgttttcccaggagaaaggctttatatagaaacggagagaaaaaaacgtgaatcaacatcaaaaaaaggcgcctgccgaattgaaaatcgggcagacatttccgctgaccatcaaacgtctcggcattaacggagagggcgtcggctattttaagaaaaaagttgtcttcgttcccggcgctctgcccggggaagaagtcgttgccgaagcgacaaatgtgcagccgaaattttcagaagcacgcgtcaaaaaaatccgcaagccgtctgaacaccgcgtcacgccgccatgcccggtctacgaccagtgcggcggctgtcagcttcagcatctggcatacacccagcagcttcgcgaaaaacgcgacattgtcattcagtctctggaacgtcatacgagattcaatgtcgaagaaatgaacattaaagatacgatcggaatggacaacccttggaattaccggaacaaaagccagttccaagtcggacgctcgcaaagcggcagcatcattgccggcttatacggacttgattctcataaaatcgtcccgattaaggaatgcattgtccagcatccggcgacaaacaaaacaacgggtatcgtccgccgtattttggaaaaacacaacgtatccgtttataacgaacggaccaaaaaaggcgatgtccgcaccatcgtgacgagagtcggttttgaaacaggcgaagtgcaggtcgtgcttgtcactgcgaaagagacactgccgaataaagatgagatcgtcaaagccattcagaaccgactgccggaagtgaaatcgattattcaaaacgtcaatggcgcgcgcacatccgtcattttcggtgacaaaacaaaagcgctggccggaagccatgccattcaagaagtgctcggtgacgtgtcatttgaactgagcgcccgcgccttcttccagctcaaccctgagcagacggtcaagctgtatgacgaagtgaaacaagcggctcagctgacaggaaaagaaaaagtcgtagacgcgtattgcggcgtcggtacgatcggcatgtgggtttcaagcggcgcaaaagagatccgcggcatggacgtcattaaagaatcaattgatgatgcgaagaaaaacgccaaaaaacacggcatcaaaaacgcggcatatgtcacaggaacagccgaacactggctcccgaaatggtcgaaagaaggcttccgtcctgacgtggtcatcgtcgacccgccgagaacgggctgtgacagaacatttttagataccatcaaaaaagtaaaaccgaaacgcttcgtctacgtatcctgcaatccttccacactggcgaaagacttgcagacgctgtcgaaggactatcgcgtcgaatatattcagcctgtggatatgtttccgcagacggctcatgtggaagccgtggcgaagcttgtgttgaaatcgtctaactaaaataaacaattcgtaatcagacctggattcggtataaacatttccgatttccgggtttttttatgcggagcctttgccctggctgtcttttctaaactttatgtttcttcttttctcggagatctttatttaaactgacgaaaagagttgaaaaacgtgtggaaaagcgagtgaaaaacagccaattttgacctcgtttgtataatgatgatgtggtgtattatgacattattgggataatgtaaaataatttgatatcattggttttagatgaagttgtaacattattcaactgtaaagtatttatcatgccaaagtaagtaggtctttaataaaagataaacaggaggtgaaaccgaatgagagatattggaatttcaacaactgaacgaaggttctgaagtagaagctgtaaaaggcaagggtgcttacttacactaatcaccagcggcagttggcacatcgataaaagatcaaacacactaaaaaagcatgtttggtcgttatacataatatgaaagcctaaacaggaaaaaaggaccccaattatttcccttattcccaaaaaaggaataaatccgaggcggaaccacaagtgataacaactcttacagtaatacctgcgatggttatatccttaataagtaattatcgcgacaatcgtgcttcatcatataatgatgttagattgtcacttggctaaaaagtattgcagaaaaggaaatggtaattgaaatgggtaaagtatataaaaaacgaccgttatataaaaaaagttggtttcacacgttgttggcatttttaatatcacagctttattttagttttgtagaattaacgggatggggtccgaattatagagaaatgaatggattcccagcaaacatagctgaactggatttctttcaaacatatctttcattctatgataatccatggtttaatattgtcactgttttcttgggggttttcactgttatacaaatcattacaggtataacaaagaatattcgaatgaaagcaataacttctgacgccttatttaatgatgaaagaaaatgaacactttcttattaatcttatgagtgaggactgcggcacttagtcagcagtctattttattggttttggatcagaattaccgaagcgtaaccttatacaaatatatataggtgattgtataaagatattaacatatgggctttgaaagccgatcgacccttagtacatatactgtatagagccaagccacttgctgcgttggttatttctaaaccatgagcaaatccgaaaagatccagattgaagttcttgaattctgttaagttcaagtttattttctcttcccatcctctttacttcatgtgattcacaatcggcaagttaaggctttttctttttacattctcttcagtactcagatatacccccccagccccatttgcttaatcaacttatttcttgaaatttgttttatggtaatagggagaactcatatgatattctatttaggttggactcctttttatccaaaaagagcaaaagtaaggccgctaagaaagatgaaggtcagcgctaatcttaataaaccacaatataaataaaaattaggtgtagataatcatcacactttttctctctcagacccttttaaaggtgaaggagttgactgagttgatcagaaatgaacggtatggggttaactatagcggtagtctattacgttaactcaattaatgtgttctactccagtttgctttttcactttttaaaaagtgaaatgttcaaaatttactatcgtttgataagaagtgctgacacatgctataagtgtaaaagaagcatggtcagtttttaattttgggataaaggtttggctgtatcccatcatgaaaggatttggatttgttatgacagataatttctggcgtgaattaccgcggccattttttgtactggcaccaatggaagatgtgacggatgtcgtttttcgccatgttgtgagtgaagcaggcagacctgatgtgtttttcacagagtttacaaactcagaaagctattgtcacccggatgggaaggatagtgtgcgcggccgtttgactttcacggaggatgaacagccgatggttgcccacatatggggagataagcctgaaaactttcgccaaatgagtattgggatggcggaattagggtttaagggcctggatatcaatatgggctgtcctgtccctaatgtggcggggaatggaaagggaagcggcctgatttgccgtcctgaagttgcggcagaattaatacaggtggcgaaagcaggaggtctgccggtaagtgtgaagacgagacttggctacacggatgttgacgaatggcgcggctggctgacacacatactgaaacaagacattgcgaatctttccattcatctgcgtacaagagcggaaatgagtaaagtagatgcgcattgggagttgatcccggaaattaagaaacttcgtgacgagattgcgccagatacccttttgacgatcaatggggatattcctgaccgggagaccggcttgaaactcgctgaacaatacggtgttgacgggattatgattggacgaggcatttttactaatccgttcgcctttgaaaaggagccgagagagcatagcagtaaggaattgcttgatcttttgagattgcatctggatctccatgatgagtattcaaaagaagaagctagagcatataaaccgctccctcgctttttcaagatatatctccgcgggttccggggagcaagtgaattaagaaatcaatgcatgaatacaaagtcaacagatgaagtgcgtgcattgctcgatgactttgagagaaagtatcttgatgggatggagcaagagtgacataaacaactcttcatccggcccggagttcggtttgaattccgggtctttttgtgtgcagcttttacccagacagatccatggccggtttcgtcatgcagaaataaacgaataatggtacattgataggacatacatcataaagggggagagaaaaatgaaacgactgtgcatcatcccctgcggcaagaaaaaaatttgggatgtccattcagatacagggccggtaagggcggaagacgcttatctcagcccgtttcatcaggcatgcgagcgatatgcgaaagcatttttcgatgagtgggtgattttgtcggcgaagcacggattccttcgtccggatgatactgttcccggaaattacgatgtcacttttggaaccggtcacccggagatcatggcagcggacgagctgcgccgtcaatttcatgaaaaaggcttttccgacgtcgaagagcttgtcatgcttggcgggaaaaaataccgaagtgttctaaatgccgtcatcggagagcatcagcatatcacctggcctctgtcatcgtataaaggcattggctacatgcttcaagcgctgaatcaggctgttgaagaaaaggatgaactgcagcacgtggatatgaaaaaaagagtgtaaccactcaaacgccgcgatagactgtatgcggaagaatgaagcaataaaagatttccgaggaaataaatacgtcgatcattgtcaaagacagggtgatgcccggtctttttttatgccataaaacgagacaaagggaacagatcgagacaaaatgagacacctgtctcaaactgtctccattgtaaaaataaaaacattcattttacgggcttcaaaggctggcatgcttcttgcatttataagtgtgaaccctaaatagaaggaggcgcccaaaatggaattgttaaaacgagaaggcttgtcattaactgaggagaaagcgctgtggatgtaccaaaagatgctggaaatcaggggctttgaagacaaagtgcatgaactgttcgcgcaaggagtgcttcccggattcgtccatttgtatgccggtgaagaagcgatagctgcgggggtgtgcgctcatttacatgatggcgacagcattacaagcacacacaggggacatggccattgtatcgccaaaggctgtgatctggacggcatgatggcggaaatattcggaaaagcgaccggactgtgtaaaggcaaaggcggctctatgcacattgcggatcttgataaaggcatgttaggcgcaaatggaatcgtcgggggcggattcacgctcgcatgcggatcagcgctcacggctaaatataaacaaactaaaaatgtaagcgtttgcttctttggggacggagccaataaccaaggcaccttccatgaagggctgaacttagcggcagtatggaaccttcctgtcgtgttcatcgccgaaaacaacggctacggcgaagccacgacatttgagtacgcgtcagcctgtgattcaatcgccgatcgggcggctgcctacaacatgcctggggtcacggtggacggaaaagatattttagcagtttatcaggcagccggggaagcgatagaaagagcaagaaacggcggaggcccgtctttgattgaatgtatgacttaccgaaactacggccatttcgaaggcgatgcccaaacttataaaacaaaggatgaaaagactgagcatcttgaagaaaaggatgctatccaaggctttaaaaactatcttctaaaagaaacagatgcaaataaattgtcagacattgaacagcgagtcagcgaatcgattgaaaaagccgtctcgttcagcgaaaagagtccgtatccgaaagagtcagagctgttgacagacgtctacgtgtcatatgaaaaagggggaatgtgagatggcgagagtcataagcatgtcggacgcgatcaatgaagcaatgaagcttgcgatgagaagagatgaaaatgtgcttttaatcggtgaggatgtcgccgggggagcggcggtcgatcatttgcaagatgatgaggcatggggcggtgtactcggggtcacaaaggggctcgtacaggaattcgggcgcagccgagtgctggatacaccgatttctgaggcgggctatatgggtgcggccatggctgcggcatccacggggctgagaccgattgccgagctgatgtttaatgattttatcggaacgtgctttgaccaagtgatcaaccaaggggcgaaattccgctatatgttcggcggtaaagcgcaagtgccgatcaccgtccgcaccacatacggagccgggttccgggcagccgctcagcattcgcaggcgctgtatggcctgttcaccagcatcccgggtctgaagacggttgtgccgtccaatccgtatgacgccaaaggtttgctgctggcggcaatagaagacaatgatccggtattcttttttgaagacaaaacgtcctacagcatgaagggcgaggtgccggaagattattatacaattccgctcggaaaagcggatatcaaacgcgaaggcagcgacatcacgctgtttgcggtcggcaagcaggttaataccgcgcttgaggcggctgcacagctttctgagaaaggcatcgacgccgaggtgcttgacccccggagtctgtctcctttagatgaggaagcgattttcacatcgctagaaaaaacaaaccggctgatcatcattgacgaagccaatccgcgctgcagcatcgccacggatattgctgcgattgtcgccgataagggctttgatttgcttgatgcgccgattaagcggattacagcgccgcatacaccggtgccgttttcgccggtgcttgaagatcaatatttgccgacaccagaccgtattgtcagcgtcacacttgaattgcttggcgagccggcaatgaattaaaggagggatatagaatggctgtaaaagtagtaatgccgaagctgggaatggcgatgaagaaaggtgaagtatccgtctggaataaaaaagtcggcgacccggtagaaaagggagaaagcatcgccagcatcaactcggaaaaaatagaaatggaaatagaagcgcctgaaagcggcacgcttcttcatattaaagtcaaagagggagaaggggtcccgccgggaacacccatctgttatatcggggaaaacggcgaagaagtgcgggagaaggaggcgccggctcctgaaaaagcagggaaaccgcaagctgaatctgaacatattcccgctccaaaagccgggcaaaagcgtaaacaccgcgtgaaaatatctcccgttgccagaaaaatggcggagaaagccggattgaaagtcgatacgctgaacgggacgggtcccggaggccgaatcgtaaaagctgacgtcatcaaggcgatgaagacggaagctgaaccgcagtcttcggtacagacggcacagccggaggaaaaaccggcttcagcgatgagaaaagtgattgcagaccgaatgcacaaaagcctgcaaaacagcgcccagctgacgctgacgatgaaagcggacattacggagcttgtaaaatggcagcagcagctcgccgacagcgcgaaaaagcggagcggtgttaaactgacggtcacacatttcgtatcccgggccgcggtgcttgcgctgaaacagcatcctgagctgaacagctcttatcaagaggagcggatcatcacctatccatatgtccacctcgggatggcggtttctcttgaaaacggtctcgtcgtgccggtgatccgggatgcggaaaagctttcattccttgagcttgcggatcacatcagcacatcggcacgccgggcgcgggaaggcaatgcttccggagatgatctgcacggatcgacattttctattacaaatctcgggggttacggaattgagcatttcaccccgattcttaatccgcctgaagccggtattctcggagtgggcgcaagctatgaaacgccggcgtttaaaggagatgagcttgtcaaaagcaccatgctgccgctgagtcttacctttgatcacagagtatgtgacggcgccccggctgcggacttcctgaaaacggtcaaagcgctgcttgaagagcctgccggtttgattttatagagagaggtgaaaaaatgaaactagccattatcggcggcgggccggccggatatgcagctgccgtgactgccgcgcggagaggagcagaagtcgttctgatcgacaaagggccgctcggaggcacttgtctcaatgaggggtgcatcccgacaaagtcgcttttggaaagtgcgaatgtgctcgataaaatcaggcatgcaaatacattcggcatcgaactgccgcaaaacattacactcaattggaactgcatgcaggggcgcaaacggcaaatcgtcagccagctcgtgcagggaattcaatacttaatgaaagcaaatcagattaaagtcatcagcgggacagcctcatttctcacagagcagacattgcttgttgaagaagaaggaggcgcaaaagacattctggaagcggaccggatattgattgcatccggatctgaaccggcggagctgccgtttgccccatttgacggcgattgggtgatcgacagcaaagatgcgctttctttacagcaaatcccttcgtctctgctcattgtcgggggaggtgtgatcggcagcgaatttgcctctttattcagccggtttaaaacgaaagtgacggtgattgaatcggctgaccggctgctcccggcagaagacggggaaatcgccgccgctttcgaagactctttaagagacagcggggctgatattcagacaaaagccgcccttcagcggattgacaaagaaaggaaaaccgccgtgtggacaaaagacggaaaagaaattgaggctcaggctgatcacattttggttgcaatcggcagaaagccgcgtttgcaagggctgaatttggatcaagccggcatccggtattctccgcgcgggattgaagtcaatgaccatatgcagaccaatgtgcctcatatatatgcgtgcggcgatgcggccggaggaatgcagctcgcgcatgccgccattcatgaaggaatcacagccgccgcgcatgcctcgggaaaggacagcaaagtcaatatgcgggcggtgccccgctgtatttatacatcgcccgaaatggcagctgtcgggctgacggaaacacaggcgagagagacatacggagatgtgaaaatcggagaatgctcattttctgctaacggaaaagcgttaattaagcatcagcacggcggcaaaatgaaaatcattgccgaaccggaattcggagaaatcgtcggagtgtcaatgatcgggccggacgtgacggaattgatcggtcaggcggtcatgatgatgaacggtgaaatgacggcggatatgtcggagcactttatcgcggcgcatccgactctgtcagaaacgcttcaggaagccctgctgaatgtcaccggacttgcggtgcattccgtataaccggaataccctttctcagatgagaaggggtatttttcgttgaaagcgctttacttttcccctacaatatatgaaaagatggtctgaacaggggggagcgaatacaatgaatgtcattcggaatgattttaaaacctggaagcgttttgtgaaagaaggcgtgctcgatgaatcccgtattcagaagcgggtggccgcctcatggcaccgctgcaaaaaagccgacgtcaatccttatctagaaaagggaccgaatgtaatgccggcagatcatttagaaaggcaggccgaaaagcatgcgttatttttagcggcctcaacgccgcacgcagaaagaatgaaaacggcgatgcgggaaatggaaatgatggttcttctgattgattctgacggcgttgtccattcagttgacggccacccgcgcaccattcatgaagcgaaccgcatcaatttcttaaaaggcgcccgctggacggaaacggccgtcggcacgaatgcgatcgggacagctctttatacaaatgagccggtcatgatacacggctctgaacattattcgctcgcttctcatcaatggagctgttccgccgcgcccatccgttatgaagacgggcggctggcgggtgtcattgatatttcctgccccgccgcccgcgctcagccttttatgctcggaattgcctcctccatcgcttatacggcggaacgggagcttgccctaaagatcaaaatgacagaacttgacatgatcagcaaattcgccgggcttacccggtctcacgatccgatcgtgctttgcaatgaaatgagccgggttatcgccgcaagccgtcccgttcagcattttaccggacatatgctgcgcgagcttgaggaacagggctatcatatcaagcagacgaagcgggaggagaacggcttctcatgcatttacttatctaaacgagaagaaaagccgtcgtttatatttcatggtgcggcaggcaaaagcccgtcatcccgacatatgctccagcagctggagcttgtcgcccgaacggacgcaaccgtttgtcttacgggagaaaccgggacgggaaaggagattgccgcccgggcgattcacaacaacagctccaggaaaaacggcccgtttatcgctgtcaactgcggggcggtccccgaaaagctgattgaaagcgaactgttcggctactcggaaggcgccttcaccggagccaaacggaaaggacataacggcgctttgcaaaaagccgataaaggcacgcttttcctcgatgaaatcggagaaatatcacactccatgcaggtcgctctgttacgggtgctgcaggagcggaaagtcaccccggtcggcgggacaaaagagattcccgttgacatcagaattatcactgccacccacactgatctgagacagcttgtcgaatgcaaaaagctgagagaagatttattttaccggcttcacgtctgtccgatccacctccctccattaagagaacgcaccgaagacattcccggcctcttccttgaatttcagcgaaatcgcggctggcggggggagcttcctgatgattttttagacctattaaagagccggaaatggccggggaacatcagggaattgtttaatgtatttgaacgtctttccgtcatgttcccggacggacggctgtcagggcgccccatcgcagccctgcttgaagcgtcaggtcttaaagaggcggccgagtcttatgaacaggaagaagcgtcccctgtctccatccgggagcacattcagaaaaacatcatcgtaaacgcgcttgaatcagcgaaggggaatgttacacaggccgccaaaatggccggaatcccgcggagcacgttttacaaacgcctcaaaaaattcaaactcaccgccggacaattgtaagaaacaagcatacttctcttggctgccggacacgttatgtgtgaggcctaaaggaggtttgagacgtgaatacacagcgtgcgaaagacatttcggaatccgccgccatggcgtatgtgacgtatgaaggagttccgatttatattcagcatgtcaacgaagacaaggaaacagccaggatttttccgatcggaaatccacaatttgagcaggaagtgctgctttctgatttacaagagcatttttgagaaggggtctgctgatgacagcaggccttttttgtacctgtgggaactttcccgatttttgagaaaaataactaaaaatgatcaaatgatctaactcctccaaacccggtacagatcggaccttctcatgatataaataaaatgtaaacgttatcagaggagggcttcacatgacagacaaatcattctcaatcgttattgcaggcggcggcagcacatttacccccggaattgtattaatgcttttgaatcacctggaagagtttccgatcagaaagctgaaactttatgacaatgataaagaaaggcaggagcggattgcgggtgcgtgtgaggtattcataaaagaaaaagcgccggacattgaatttttggcgactgatgacccagagacggcttttacggatgttgacttcgtcatggcgcatatccgcgtcggaaaatatgcgatgcgcgcactcgatgaacaaatcccgctgaagtacggcgtggtcggccaggaaacatgcgggccgggcggaatcgcatacggcatgcgctctatcggcggtgttctggagattcttgattatatggaaacgtactcgcctgacgcatggatgctgaattactccaatccggcggcgattgtggccgaagctacacggcgcctcagaccgaattcaaaaatattgaacatctgcgacatgccggtcggaattgaggatcgcatggcgaacatcctcggattatcttcacgaaaagaaatgaacgtccgttactacggcttgaaccactttggctggtggacgtccatcaccgatcgagagggcaatgatttaatgccgaagctgaaagagcatgtccgtgaatacggctacgttccgaagacggaggccgaacagactgaagcaagctggaatgacacattcaaaaaagcgcgcgacgtacaggcggctgatccggatacgcttccgaacacatatctgcaatattacttattcccggatgatatggtgaaaaaatcaaatccgaaccatacgagagccaacgaagtcatggaagggcgggaagctttcattttcagccaatgcgatatgattacgcgcgaacaatcatcggagaacagtgaaattaaaattgatgatcatgcttcctatatcgtcgaccttgcccgggccatcgcttacaacacaggggagagaatgctgttaatcgttgaaaataacggcgcgatcgcaaactttgatccgtcagccatggttgagattccttgtctcgtaggttcaaacggaccggaaccgctctcagtcgggaacataccgcaatttcaaaaaggcctgatggaacagcaggtgtctgtcgaaaaactgacggctgaagcgtgggaagagcggtcgtttcaaaagctgtggcaggcgctgatcctgtcaaaaacagtgccgaatgcccgtgtggcaagactgattcttgaagatctgatggaggctaataaagactactggcctgagcttgatgtaagcccgtctcctatttcctgatgacaatcttccccgttttctttatctgttattctatataatagaaagaaaacggggggatttttgggatgagtcttgaagaactggttaatcagcattacgcgaaattaaatgacaacgatttttatattttaaaatatatattgaatcataagcatacgtgctaccatctcggtatcaatgacatggcgaaagcctgcaatgtctctcggtcttccatcctgcggctcgcccaaaaactgggcttcagcggctatagtgaattccgtgtttttctgaaatgggaggatcagcctgaagagggcgagaatatgacgtttgaaaagctgctggatgatattgaagccaatgtaaaatacgtgaagtcaaaagatatgacggagatgtgccggctgatagatgaagcaaaacggattttcgtttacggatcggggacggctcagagggtgtgcgcccgtgagctgcagcggatgtttgtatcccggcggaagtatctgattttaattcaggacatcacagagtttgatatcatgtgtgatgattttaaggttgatgacgtattcatcattatttctttatcaggcgaaacacccgaattaattccgcaggtaaggaccctgtccgcaaagggagttccgtttatttcaatcaccaatctgaaaaacaacgtcctggcgcaaacgacgccgtataatctttatgcgaccagcaagccggtgacgttaagcgataaaacggaaattgtcgcatttgccccgttttttctggtgggcgaatcgttattccgtgcatatgttgattataaagagcttgaaaattttgatgaatagcgggaggtcacgtgaaatgatgcaaaaagtccagcgcttcggcagcgcgatgtttgtgcctgttttgttatttgcattttccggaattattgtcggtctgagcacgctgtttaaaaataaaacgctgatggggccgctggctgatcctgacgggctttggtatcaatgctggtatgtcattgaacaaggcggctggaccgtctttaatcaaatgccgctcctgtttgcgatcggcatccctgtcgccttagcgaaaaaagcgcaggcgcgggcttgtttggaagcgcttacagtttatctgacattcaattactttatcaatgcgattctgacggtttggggcggggcttttcatgtcgatatgactcaggaagccggcggaacgagcgggctgacgatgatcgccgggatcaaaacgcttgatacgaatattatcggcgccatctttatttcatctattgtcgtgtatttgcacaatcgtttctttgataaaaaactgccggattttctggggatttttcaaggatcttcctacatcgttatcatttctttcttcattatgataccgatttcacttgcggtggcatacgtatggccgatggttcagtccggaatcggctcgctgcaaagttttctcgtttcttccggggcgatcggcgtgtggatttacacattcctggagcggattttaataccgaccggcctgcatcattttatttactcgccgtttgtttacggtccggctgtggctgaaggcggtatcgttacctattgggctcagcatctcggggaatactctcaaagcgtcaaaccgctgaaagaattgttcccgcaggggggcttcgcgcttcacggcaactcgaaaatcttcggcataccggggatcgcgctcgctttttacgccacggcttcaaaggaaaagaaaaaaatcgtcgccggccttttgatcccggtcaccttgacgtccattgtagcgggaattacagagccgattgaatttacattcctttttatctcgccgtttttatttgcggttcatgctttgcttgccgcttccatggcaaccgtcatgtatatggccggcgtcgtcggaaatatgggaggcggtttgatcgaagctgcgaccttgaactggatcccgctggcgtcaagccacggcttgacgtatgtataccagatcatcatcgggttgtgttttaccgctgtttactttttcgtcttccgtttcctcattctcaaattcaacatcgccacaccgggcagagaaaaagaggaagggcaggaaacaaagctctattcgaaaaaggagtacagagaacggaagcaggcttcaaaagaaacagcggcggcagacgaaacacagcgggatacggccgctttgtatattgaagcgctgggcggaaaggacaatattacggaggtcaccaattgcgccacccgtctccgcgtcactgtcgctgatgaatcaaaggtcaaaagtgacgccgatttcagagagctgggagcccacggcgtcgtcagaaaaggcagggcgcttcaggtcattgtcggattaggcgttccgcaaatgcgggagcgtgtcgagaaaatattgaacggttaaaatactgcagcagcagactatgtgcagagcgcttgttaatccggcgctctttttatgttttgaaaaaaatgtatgaatttgtcatacctttgccacctgtacatgcaggagtgaaaacgagggggtgcaaaaaacgaaatgacttctgcggtattttaaatagcaattaacaaataggaggcaaggcaatgacaaactatacgactttcttaggactttacaaacccgataaaacggaggggattgaggttgaaagcattgctcaaaactttgaagcgattgacagcaaaatcggtgctgcgcttagcaatggcacgtcaacttatgaaaatttaaacgaaagacttaaaatgtatgaaaacagatttgaacatgtgacagagcggaacgttatggattttggagctaaaggtgacggcgtaacggatgatacgcaggcatttcatgatgccatggccgacggaggttatgtcgtaacagtacccccgggtatattcagaacatccggattgtttgttccgtcaaatacaatgcttgtcggagcaggcaagaaaagaacggtcattaaattattagacgaaacaccggtcggccattctgttctgaccaacagcgattatacgaacgggaatgaaaatatttacgtcggccatcttacgttggactggaacaaggatacgcgtcctgccggctggaagattccgaagggccctacttcaagctgtttgctttttgcgaatgttgactattcttttgtcgagcatgtgtttgcgaagaacgccggcctgcacggctttgattccacgagcccgaactataacagacatggagaaatggacgaccccacttattatcagcccaacggctgtaactttgtaactttctctcattgtgaagcaacagggtccggcgatgataactttacttgtcattttggattccatactacttttagccattgtatttcttatcacccgatgggaaatgggaatggcacgtccaattcaaattgctttgagatcgatgacggttctcaagatgtatttttagatagctgtgttgcaattggcggtgcccgcggttttgaaattaaggcgcatgactatgcaccggcggctaaacgggttcaactggctaattgccgtgcttacgaaaatgcaatcggtttttgtattagacatattggccaccatttatcgggtgagccgacatcaaaaactgcccatgatgttcaattagtaaattgtcaggcaacaaatcctaaacagaattctatatataaaggcgtcggggcgagtgctttggttgtttcgggctatgattcagttaatatagtgaatttccaagctatttgtgaagatcgttcatacgattacagcaatgacacgatcattatgatttattacaaagggcggtatgtcaatctgaagaatattacgatccgcgggttccgctccgctgctcatgatctgtatgttcttggcggagaaaatgcggtaggaaagtgcatgattgacggtgtttttctagttgacggcggcacgacgggacttgcttttggcggaggcgttgataattgtacagtgagcaatgtatacgggcatagattgggagccggcagcggaacggtcggactctattcttcgggtccggatctgaatatatcaaatattgattttcaaggatatgaaacaacatttcatgtaggcggtaaaaaaacaccgtatgagttgtttaaacataaaggatcttctgttatggcatctaaagattcccacgttacaggaactaatggctttgtcgtcggttctgtccgggggcaggctgcaggaggttctcaatctggagtaatcggttcatataatacgattaacccaaatgcgaactcaactgtatggggctggggttccggcagcactccgttatcagccaacagaaagattgagcttcacgcaaaagaaggaacaattaaggctgcgggaggcgtaacaggttcctcgacattctctgactacgccgagtattttgaaagcctgagaggggaaaagattccgacgggaacacttgtcacacttgaaggtgataagatcagaccggctgaaaaaggtgacctcatgctgggggtcatttccgagaccgccggagtgattcttggcgagtcgagttttcactggtcgggacgatacgtaaagaatgaatttggcggctatgtttatgaagaacagaaagatgcgaacggccatatggtcatggcgccaaaggaaaatccggactttcggcctgaagaagattacgcttcaagagaagagagagacgagtggaacattgtcggactcatcggccaggtatatgtcagatgcgatgagtctgtgaaagcgggagattttattcacgctcataacgggattgcaacaaaatctgatgctccaaatcagcgctggcaggtcatgaaagtgatcaatgagtttgatgctgataaaggattcggggtcgctctcgttttcattcgttaaatgaaatgaaaaagcataaatgaccttcctgaatagcggacgcctttttaaaggctccgctaattcattttaaaatcaaagctccggttcaggagctggtaaaaaagaaaagataagacagcctccatatatctgcacgcctcatatcctcaatttttatcctcaatgattttcgttttttttacacaaagtacataataaaagtgcgccgttcaagggttaatcctttattcatttaagacaaacaaataaaataaatatacatacatattgaacaaaggatttggaggcttacacatgtcaaaggctttatcatatgtaaaaccgtattcccttttggcgggaatcgctctgtttttcatgctcatcgagcttgcggtagagctgatacagcccctgctgatcgggaaaatcattgacgaaggaattttaaagcaggatctcggtacggtttggctgtggggcggtgtgatgatcggaatgaccgctgtttcattcgcatcgggaattttaaattcattctactccgcccacatcagccagagctatgcgtatgatacgcgaaaagggctttttcaaaaaatccagtccttctcttattcgacgtttgcgcaattctcatctacgtcgtttatcaccaggctgacaaacgatgtgacgcaggtccagaatatgcttttcatgagtctccggtttatgcttcgtgcgccgttaatgatcgcgggcggcattattctctcgctgaccgtcaatgtgaaactcgggttttttctgctgatcacggtgccgattttgcttttgtttttgctgtgggtgctgaaaagaggcggcgcgctgtttcggtccgtgcaaaagcggcttgatcaggtcaacacgatcatgcaggaaaacctgacggcgatcaaactgattaaagcgctcctccgtgcaaaccacgaagtgaaacgttttttgaaatcgaatacgaagctgatggaaaaaacggtctccgcttttcgtctcgtggaagcggcgatgccgattttaatgctgctgatgaacagctgcattttgtttatcttatggttcggcgccaaaagcattgctcagggcggagcgcaggtcggcgatgtcgtttccgtcattaactatgcgacgcggattacaggtgcgctgtccgtcctgccatttctcattatggtattttcccgggcgaaggcttccggggaaagaatcggcgaggtgctggaaacagaaggcggcgagggaacggggcacgacccggcacgggcgctagcaggcgggattgagtttcgcgaagtgtccttccgctatccggacatggaaaaagacgcgctgcatcacgtgtccttttcagccagcccgagagaaacggttgccattatgggcgcgacaggttcagggaaatcaacgctttttcagctgattccgcgcctgtacacggctgattcgggcagtattttcatagacggcaaaccgatcggtgaattctccgcttgcgggctgcgcagggaaatcggctatgtgccgcaggaagtgcttctgttttcgggcacaatccgtgaaaatatcgcctggggacgggaggatgcttcactagatgaagtaatggaagcggccaaagacgcgcaaatccatgacacgattatgaagctgtcaaacgggtacgacacggtgctgggacagcggggcgtcaatttgtcaggcgggcagaagcagcggatttccatcgcgcgcgcttttatcagaaagccgtccctcctgctgttagatgacagtacgagcgcgctcgatcttcaaacggaagcgaagcttttacaagcgatcagatcctatgaatgcacgacactgcttattacgcagaaaataacgaccgcgatgaaggctgacaccatcttattgcttgaagacggcgaactgcttgcaaaaggcacgcacaaagagctgatggcacagtctcatctgtaccggcagatttatgaatcacaattcggaaaggagggagctgacagtggagaaagacattcgtaaacctttccgatatccgaaaataccgctcaaaccaaatgaaggcggcagaaaacgcgcgaaagcaaaagatacaaaaggcacgctgcgcagaatctggtcgtatgtagccgagaaaaaagggcttttaacccttgtgatcatcatggtagtcataagcgccatattcggcctgctcggaccgttcgtcatcgggaaagcaattgatcattttatcgtcggacggacgacggacggattggcgggggtgctgttcttgctgtttgggatttacctcgtgcaatcattgtccttatggtttcaaaactattggatgatcaatatttcgcaaagcaccgtgtttaaaatgcggagcgaactgttcacccatctgcatgagctgccgataccgttttttgataaacagcgcctcggcgacttgatgagccgggttaccaatgatatcgaaaatgtcagctccactttaaatacatccgtcattcaagtgctgtcgagcgtcattacattcgtcggcacaatcgccgtcatgctgtacatgagtccgcttttaacattgatcacgcttttgattattccgatcatgcttttgagcattaaatggatcaccaatcggacgggactcctgtttaagcagcagcagaaaaacctcggcgagctgaacggttttattgaagagtcgatatcaggagcgaaggtcattaaagcctattcgagggaagaccgcgtcatggagcaatttttagaaaaaaacgcggcgttacaatcatcagggttttgggcgcagacaatttcgggattcattccgaaagtcatgaactctttaaacaatttaagctttacgattatagcggcggtcggcgggctgtttgcgctgaaggggtggatttcgatcggttccatcgtcgtattcgcagaatactcgcggcagttcacgcgccctttaaatgatttagccaatcagttcaatacgatgttatcggccatcgccggggctgaacgggtgtttgacgtgctggatgaaaaagaggagcgggaagatgaagagcatgcgacgcaccagccgatcaaaacgggagagattgaattccgagatgtctccttcggctatcaggaagacagcctgatcttaaaacatctgtccttcagcgttccgaaaggacagtcaatcgccttcgtcggaccgaccggagcgggtaaaacgaccgttacgagcctgatcgcccgcttttacgagccgaataacgggaaaatcctcatcgacggaacggacatcaaaaaactgacgagatccagtctgagaaaaaacatggggtttgtcctgcaggattcctttctctttcagggcaccatcagggaaaatatccgttacggccgtctggatgcatctgaccaagaggtggaggcagccgcaaaagccgccaatgcccatggattcatcgaacggctcccgaaaggctacgataccgtccttacccaaaacggcgcgggcatcagccaaggacaaaaacagcttatttccatcgcgagagctgtgctggcggaccctgtgctgctcattttggatgaagcgacgagcaacattgatacggtgacggaagtgaaaatacaagaagcgctcggccgtttaatggcgggcagaacaagcgtcatcatcgctcacaggctgaacacgattcaaaaagccgatcagattcttgtgctgaaagacggcgaaatggctgaaaaaggaacccatgccgaactgctcagccagaacgggttttaccgggaattatatgaaagccagttccgggaatcatagatagggaaaaagacctccgacagagtgcggaggtctttttttgcgaagacaaatagtacttttaagttattttcgttaaatgtaacaaaattacttgacgtaaataagttatgtatatatactagcttacataaagtaagtgataataattttcaaggaggattttatgaataaatcattcgaaacaggaacactgcttttaagggttgtaacaggtattatcttttttgttcacggtttatccaagtttcaagggttggaaggaactacgcaatttttccagagcatcgggcttccggcctttatggtctatgtcatcgcaacgattgagcttgtcggcggggttctgatctttttcggtttggcgacgcgcataatcggcgttctgtttgccctcacattagtcggcgccatcttcacggcgaagctttcctcaccatttatgggcggatcggaatttgatttcatcttactggttgcgtcaattcacttagcgctttcaggaagccgactgctttcattggatcagctccttttcaaatcaaaaaagggagaaactttttcagcataagaaagaaggcgttcaaatgaccggcattcatcaagatacggcaatcggttatgtcaaattgaccattaaaaatatggaacggtcgctcggcttttaccaaaatgtgatcggccttcaagtcatctcgcaaaccgatcgttccgcagaactgtcagcagacggaaaacgcgtcctgctggtgcttgaagaaaatccaagcgccgtcgttctcccggagcggtctgtcaccggcctttaccatttcgcaatacttctgcctgaccggaaagaactcggcatcgcattggccaggctgattgaaaacggcatcgcgctcgggcagggggatcacgcagtcagtgaggctctttacctgtctgatccggacggcaacggcattgaaatatacgccgatcgtccccgcagcacgtggcgccgggatgcagagggcaattacgtcatgcaaacggcgcccgtcgatgtggacgggcttttggaagaagccggagctgaacggaaaagccgtctcccggaaggaaccgtaatcggtcacatccatcttcatgtgacggatttacaggaagccaaagcgttttacaccgatatcctcggttttgacattgtcggcaattacgcgggcatgtccgctctgtttgtttcagcgggagggtatcaccatcacatcggtctgaatatatgggccggaaaacatgcgccgccgaaaccgggaaatgcaagcgggctggattattacaccatcgcactgccgcatcaaaaagagctgtcacgtgtgacaaaagcgctgaccgatgccggctttgagatcgaagaaaaagaagagggcgtattcgtcaaagaccctgtatcaggggcggatatcgcatttacactgtaagaaacaacccttgccgtctaaccggcaagggtttttatttttccgaagttttcttgggaaggctcgggaaagaagaacgtcgatttgcaatatacacacggcttttgtgtgactgaagagagcgaacatctcagtggggcgcaaaaatgatgcgtggagcccgccatcgccggcccgggctcagggcatccgctggattgaaaatggtgtccgttcggcggatcagggagcagtatgggcagactttgaatagaaaaagggaaaagccgcatccggtcacaagatgcggcttttcatatacaatttacaattgtgtgaaaaatgcccaaaataaattgtgcttcctgattcttcctgatatgataagccgaaaaaggagaacctcaacaaatgaattcaaatgcagcacagacggaacagtctatgaagcataacggaaaccggatgacggtcaaggactttatcattcttgccaaaccggggattatcatctcaaattcactcgccgcattgggcggattttggatcgcatggcttcagtcggaaaggacgggcggagggcccggtatatttgccgccatggcggttgccatgatcggaacggcgttagtcatggcgtcaagcactgtttttaataacttctttgaccgcggcatggacgcaaagatggcgcgaacccgcacccgcgccagcgtcacgggaaaaataccgccgacggtcatgatcctgtacggcacatgtctcggcgcatgcggattcatcacgcttgcttcgcttaatgtactgaccgccgttcttggcctgcttgcatttttgctgtatgccgtcgtttatacgctttggtttaaaagacaatccgtctggagcacatttgtcggcagctttccgggggcggctccgcctttaatcggttattgcgcgctgaccgggtacattgatatgcccgcaattttgttatacgcgattatgtttttgtggcagccgccgcatttctgggcgatcggaatcaggcgaaaggaagagtatcgtgccgccggcattccgcttttgccgatcataaaaggcaatcgcgtcacaaaaataaaaatgctgcgctatatcgccgttctgactgcggtttcgctgctcgttcctctttatatagacgtcagcccgttttataccgcaaccgctctcctgctcggggccatctggctgtaccggagcgtcaaaggctttcaggcggcggatgacacgcaatggtcgaaggggatgtttttttattcgattgtttatttcagtctgctttttcttattttaatggctgattcgtttgtcaatgcggttctcagaacgtaaacaggcggcctgcagatacagagccgccccgttttgtttatgcttttttgatgagcgccaaaatatcttcaagccaggaaatataattccgttcccgctcaagcgcttttgtcagcacgagataatggccgaaatcaggagaagaaaatgaatccgcctccgcggacgatgtcatcagttcttgataactgttttccaggtcggacaatttctcctgccgctttacgagctgatcggtgaagagctcatccgcttcctcctgcgtcaaagcagagatgaaataggccttcagcataaattcatccttcaccgtttccggaatcgggtcttttttcgtcagccaggcagcaagctccagctctcccttgtcagtcagcgtgtacatttttttctcaagcttcgttccttgaatcgcagtgcgaaacgtaataaatccctcagccgtcagtttttttaattccggataaatctggctgtgctttgcgctccaaaactggccgagctcttccttaaaatagctcgatatatcatatccgctcaattcgccttttcgcaaaagccctaaaatcgcgtactttaaaattctcatgttgtcctccaagcccattcatttgacagctagtataccatacggccgcttaaaaacgcagaagcgccggatgcttgtcattgaatccgcggcggcaaaatcagcgaaaatttgcagcaaggggttagcgaaacggcagcagaaccggaaaaagcctttctcgtgtctttgcctcattcatatgacatcatgatataatcattgtaaaaattaataaatactgggagggacatatgaagacggtgattgtgtatgcaaacccggatgagaacagtttcaatgcggctctcgtaaaatacgtcgccatggctttaaaggacagcggccaaagctatacggtcattgatttatacgccgatcaatttgatcccgtgctgaagtacggcggcgaaaaaaagcgctctgacatgaaccgggacactgaaacgaagaaataccggaaactgatgaaagaagcggatcatctcattttcatctacccgctgtggtggggaggcgttccggcgattatgaaaggcttttttgacagagtgcttgtcgccggagaagcctacacatatgaaaacggccgcgtaaaaggactgctccgggcagagacggcacaggtcttttatacggcggactccccgggctggtacttaaagtggttccggaaaaactcggactggattacgctgaaaaaaggcattctgcaattttgcggcattcaaaaagccgagcggaaccttttttctgtcgtcagaacgagcacacccgaactgcgggaaaaatggctgcgccaagcatacgccaaagtccggcgcgcttgtgaaaaaggagcggccgcatgcagataaaagaaattttcgtaattcgctgcctgtcctgtttaagtgtcgttctgcttcacgcagtttcaatggtgctgatgattcaggaagagtccttagccagtgccgcccatacggttgatgcgtttcggaccctgttgatgttcagcacgccggcgtttatctttatttcggaatttctgcttgccaggtcatacccgaaaggcgttccagcgggttttttaaagaaaaggggcaaagtcattttcgtgccgtttctgtttattgccgcggtggatgccattttaatgaaaagcgtggcggaagaaggagccggattcgtttcagtgatcggtaaatttttagaaaatgtgtttttaggaaacttcatcggctacttcattcttgtgatctttcaattttacattctccatatgctgctgcaccgctggctgaacaacacatccccagtatgggtgctgtctgtttcgtttatcatcaacgccgtctatctggcttacttttcgatctttcatccgccggcatcatcggggcttgattctatttttccgttcttttgggttccgtttccgggctgggtgttttatttctgtctggcattttattgcggaaaggaatatccgcgttttttatcgctcatcaatcagtaccgttatgcggtttacttcagtgcggccgtatcggcaatattgattgtggccgtttcatatatcagcggcggctccatttcctctaagcgtccggatattatgatttacgcggtcagtatgatctttctgtgttttcatctgttttcaaagctcaaaaaagtgcccgcgattgtgatgatgatcagcaactattcgttttcaatctatctgctgcactcctactttttaatcagcggatatcttctggaaggctatttgcggtcaatgcctttagcggctgccattcttcttttatttttgatctgcacgctcggtcccattttcgtatcgtgggggtgcaaccatttcagatacggatacctgtttgtcgggaaagtgtatcagccgaagcagaccaaaagaaatacggcggcgcatcaaggccgcacagtctgaaaaaaaggcggcgtttcggccgcctttttgatacgggtccgctttatcctgcacgaggacggatagttgtacatcctgcaaacaaagcccccgcctgcggctgttttgacggatgcatttatgacaaaataacgccattgattttctcccttgtgaagaccgatatattgtatacttataggaaatactttcaaaaaaagtgaaaaagagaaaaactgtgagcttggatgaacgactaaaaaggagcggggacattatgaatgactgtgtcaaaacattcggagaacttccggccgaactttattcctttgcgggaggaaaaggaagcattctctctaaaatgtatcaaagcgggtatcctgtgcctgaagggtttgtgattttgccgtcagcctttcaggacggacagctccgccatcaggcgagagaggctgttgatcaatatgtgaattccatccgcagccgccatgcagctgcgttgtttgccgtacgctcatccgcgctgagcgaggattccgctcaggcttccttcgccggagaattcgatacggtgttgaatgtcaaaacagatcaagacatgtccagggcgattgatgaagttcgccggtcggtacagtcagaaagagtaaaagcgtacagcgccgttcagggaatggaagatgagcatgaaatcgcaatcgtcatccagctgatgataccgtctgagatatccggagtgctgtttaccgcagatccgattacggggagcaggcgggagatgacaggcaattacgtctacggtctcggggagcagctcgtttctggggaagccgatgcctattcttttaaactggcacggcccaagaaaaaatatgacggccccggggaatttcgcaaatatgcgtcaaagctctataaactggcgaaaaagctggaaaaagatcttggagggccgcaggatattgaatgggccgccgcgggcgggacattgtatattcttcaatcccgcccgattacgaccttacaagccggaaatctggaaacctatgaatggaacgattctttcagcggtgattttttatggacaaacaccaatataggagaagcgattcccgatgtgatgacgccgctgacatggtcgctcctccggaatctggatgaagagtcgggcatcattccgggctattatgtctggtccggcaatatttgcggcagagcctataacaatatgagccagcctctttccgttctcgccgctttcggtctgaatccgaaaggcggaaaaattggaaaaatgatgagcgatacattgggagaaatcccggcggaaatgaagattcctttatatccgttctcaaagtatgaacttttgaagatcatcccgaaaaaactgaaaccgtatctgtcgaaaatgaagcaagcgaaaaaaaacatgtcctcctacttggacgaatcgccggagtggtgccggaatattgaggaaaagctgaaacgcgccgaaacggagcgggcattattagcgatatggaacaatgagatctatccgtatttatgcaacgcgtggtttgcgttaatatccggcgggcgtgattctgcgcaatcctcttcgtcgttaacctctcaattaacaaaactcgcaggcatagaagatgcgaatctcctgctttccaatctgaggggaaaaggcggactggccagcctggagccgattatcggcattgatcaagtcatgaaaggccgtatgagcgaggaagaatatctcaggaaccaaggccaccgtggtccgcatgaatacgaactttccataccgcatccgggagaaaaccgggattggctgacgaagcagatcaaagaacacaaggagtcgggtattgatgccgaacaactgcttttgaaacagcagcgggcgcatgaacaggccttccgaagatttgaaaaaaagtttcctcataaggtcaaatggctcaaagccaaaatggaaaaagcgtcagaatacgcgaatatgagagaaacaaccagatccgaatttgtcagggtgtaccggacagccagagcattcgcgctcagagcggcggaaatgaccggcatgaaggacgatattttctttctgtatctgcatgaaataaccgatctgctcgcggggaaagagccggcggttgcgtcgattcaagcgagaaagcaaaactatgaaacctataaaaaactgccgccgttcccatccgttattaacggaagattcaatccgtttaaatgggctgaggatcctgacagaagagcggattattacgatgcttttatgcctgcggaaacggatgatgcgcatactttaaaaggtttcgcgggagcggccgggagagtggagggcattgtccgtgtccttgatgtcccggaagacggggattcttttgcggcgggggaaattttagtgacgtcgacaactaatgtaggctggaccccgctttttccaagagcggctgctatcataacggacgtcggcgcccctttgtcccacgcggcgatcgtcgcccgggaactggggattcctgccgttgtcgggtgcggaaatgcaacgtcaaaactgaaaacgggggacagggtggccgttgacggcgggcaaggaatcgttcagctggaaccgcggcagactccggtcacttctgaagaggaaaatggtaaactgatagaataaaatcaagagaaaggagccgcgcatgaataaagcagttattaacggggagcaaatcagaagtatgagcgacctgcaccagacattgaaaaaggaacttgcccttcctgaatactacggtgaaaaccttgacgctttatgggattgtctgaccggctgggtggaatatcccctcgttttagaatggagacagtttgaacaaagcaagcagtttacagaaaatggcgccgagagtgtgcttcaggtctttcgtgaagcgaaagcggaaggctgcgacatcaccatcatactttcataatacgatcagcgggagagagacaaaaatggaaaaacaaaccctcagctatccgattggagaatatcagccggctgaatcgatttcgtccggacagaaacaagaatggatcaatgcgctggaacacgctccggccaaactgaaacaagctgtcagagcgatgtcggacagtcagcttgatacgccgtaccgcgaagggggatggactgtccgccaagtggttcaccatctggcggacagccacatgaacggctatacccggtttaaattgagcttaacggagaatgaaccggaaatccgtccttatgatgaaaaaggctgggccgctcttcatgattccaaaaccgccgcttgcggggatgcgcttgagctgttaacgatcctgcacagaagatgggccgctcttttgcactccatgacggaagcccaattcaaacggacatacttccatcctgtatctaaagagacggttacgctggaacaggcgctcgggctatatgtctggcactctgaacatcacatcgcccatattactgagctttcccggcggatgggctggcatctgtcttagaggatgccggcttccggaaaaacgccaaaacagccgcagacacgatcgtgcataatgaaatgacggcggctgccgtataaagatggtggtagccgctggaaatgcccgcttcaatcgcatcagaaaccgcttttttgacggcgggaacggggattcggcttacctgctcctgcaacgaagaaagttcgccgccaatatcgggcgtttgcgcctgatcagcgggaatgccgcttttcattaagcggtttttaatgtcatctccgatccggtcaaagcccgctgtaatgaagccggcatataaagccggagagagcgtcagcccgacctgccttacgagtgacagcgtgccgagcgctgttcctttgttatggcccgctgtttctgatacaagcacattcagcggagccccgagcagaaatccgaaaccgatccccgcaatgacactcgccgtgacaaattcccatttatccgtcacccataacggaaacaggctgaatccggcaaaggcgatggcgcctgatacagccgcggagaagaccggcccttttttatccgtgaccgccccgccgagccacgctccgatgcctgacgccaacgcaagcggcgtcatccaataacccgctttctccgccgatacgtgcaaatattgctccgcataagaaggaataaaaatgaccgcagcgagcagccctcccgataaaaatccgatgacgagcgtccattgaaacactttattttgcagcagcgagtaggcgagaatcggatcgccccccaggttttcaacccgcttttcgaccttaagcagcaccagaaagagaagtgccgctcccaaaagatacccgtacacctttacgtccattatgctttctgacagcttcgccccattgagattcgtgataccgatcatacaagataagatcgcaagagacagcagcattgtgccggcgagatcaagccgtttcgcctcaggctctttcgtttcagcgataaacaaaccgccgcacacaaccaaagcggcggcaatcggcaggttaatcaagaacagccaatgccacgacccggttacatcaagcaaaaagctcccgatattcggtccgaggacggccgccataccgttcatcgcccctaaaagcccgagagctttcccctgtttctccttcggaagcacggccagcacatgcgaactcccgattataaaaattccgccgccgccaagcgcctgaatgagccgtgccgccaaaaacatcgggaagctctgactgagtgcgacaagcaaagagccgagtccgaacagcccgacctccatcataaacagctttttccgcccgtatcggtccgacagcttgccgacaatcggcacactgacactgagtcccaatgtgtaaagggtcactccccacgatccccatgaaggagaaacatcaaaagagctgttaatcgccgtcagagcagcggaaataattccgttgtccagcgccgccatgaacacaccgatcgtaaaaagagtgatggcccggctctggtttttttctgtttgcaatagctcccccatactgatcaatccttccgtttttagttcacttcgagtatattattcactttaagtgaattaaatgtcaaacaaaaaaaggccgccgataccggcaggcctttttcatctctatgcctgtttggaagaatcaagcgctcttgccaaaatggcaagtccttgattgaccgtttgtttttcttcagcggtcagcgtttccaatgaacgcttcaattttacatgtcctttttgataaaggctgcggaaaatatcttttgcgttttccgttaattgaacgacgactgaacggcggtcttcttctgacggagcgcgtgtaatgaaacatgatttttctaaacggtcaaggagccccgtcgtatttgaaagagaagcgcccattttctccgctatgtcactcaccttaagcgtcccgtggttgttcagaagcatcagcaccttcatttgcggcatgctcatatcaagcttcatccactccgacacatcgccgagtcccgccgaggtcatcactttcatgtacagcacccaaatatcccgttcctcaggagaaaaaatatcgccgcctaataccgttgtatcatgcagattataatccatcgtctcacttcctcattcatactcctgcataccatattactgattttaatcagagaaagaaagttgcagacgagttttgtttgaatgtgaggtggtagtgtataatatgttggagattattgggggaattataataaataagctattttatgatgattggagagaacattgctgactaaaaagaatgccttatcgatattaaaagtattatttcctattgcagttttgcttttagtcatttatcagtccaaaaaggaattgacagacctttcttttaaacgaacgctgtatattattaacgggattgagcgttacgatttatttattctcgttctgctcggccttcttgccgtcagcgcgatgtccttttatgactttgtgctgaaacggacgcttcgcctcaacattccgaattggaaagtattcagggtctcctttatcgccaattcctttaacaatgtccttggattcggcggtctggcgggcgtcgggctgcggacgatgctttacaaagagcatacgaatgacgtaaaacgccttgtcgcaggcatcgcctggcttacgtcctcagcgttgctcgggctgtccgtcttcagtatcctgaccattgcccgcattctgccggtcggagagattacaggtgagaaaccgtggctgtgggctgtaatcgccggagtggcgcttattgtgccggcagccttaatcgccgcttggatcaacaataaaaaagctcgcgcagaagacggtgaagcaaaaccgaggcatccggttttttcttacatcggggcatcgtttgccgaatggtttgcggcggccgtcgtcatgtattattccctgtatgtcatggggattcacgcggatgtccgccatgtattcggtgtatttgccattgccgctatcgggggaatcatcagccttgtgccgggaggattcggttcgtttgaccttctgtttctgctcggcatgcagaatatgggctttccgcaggaggcggttgtgacatccatcgtcatctaccggattgtgtattcatttattccgtttgtgttcgggctgttctttgcggccggcgatttaacggaaaatacgcttaaacggctggaatcaaatccgaagatggcgcccgccgtggaaacgacgaacgtgcttctcgtattccagcgcgccatcttaatcagagtgctttacggttcgctgtcgcttttggtttttatggcgggagtcgttgtgcttgcgtccgtcgccctgccgattgacagggagacggtcatcccgcatattccgcgcccggcgctccttgcgtttaacgcgttatcgttaagcgcggctttgattcttttaatcttgccgattgaattatacaaacggacgaaacgttcttattcaatggcggttgccgcgctggtcggcggttttgtgttcagtttcttaaaaggattgaacatcagcgcgatctttattctgcctgtcgtcattgtattgctggtgctgttaaagcggcagtttatcagagagcaggcatcgtatacgctcggccagatgatttttgccgccgctctgtttattatcgccttgtttaactacaatctcattgccggctttatttgggataaaatgaatcggctgctgcgccacgattatttcgttcataacaattctcacattacatatgccacgatgacggccattattgttgtgccgctgtttttccttttgtttacggtcttttatcataaaagatcgaagccgatcggagaaaaggccgatcctgaacggctgaagtcctttttggcggaagaaggcggaaacgccctcagccatctcggctttctcggggataagcggttttatttctcaagcgacggcaaagcgcttttattgttcggccagatttccagaaggcttgtcgtgctcggtgatccgtcaggacagagagactcttttccgcttgtgattgaggaatttctgaatgaagcgcataagcaggggctgagtgtcatgttttatcagatcgaacgtgaagatctggcgctgtaccatgacttcggctataacttcttcaagctcggagaagaggcgttcgtggatatggaagcatttacgctgtcaggtaagaaaaaagcggggctgcgggcgattaacaacaaatttgaccgcgaaggctacacatttcatgtcggggaaccgccgttttcctccgagtttatcgccaagctgaaagacatttcggacgaatggctcggaccgaaaaaagagaaaggtttttctctcggtttcttcgaccgggattatctggaacaggcgccgattgcttacgtgaaagacgcggaaggggagatcatcgcttttgccaacctgatgccgatgtatcaggaaggcgagatatcagtcgacttgatgcgttatcggaaaagtgcgccgaacgggattatggacgcgcttttcatccgtctgtttctctgggcgcaggaaaaaggctataccacctttaatatgggcatggcgcctttgtcaaacgtaggaacggcttttacatctttctggtcggaaagaatcgcggccgtcattttcaacaacgtccggtatatgtacagcttcagcgggctgcgggcctttaaagaaaaatacaaaccggagtggcgcgggaaatacttggcgtaccgcaaaaacagatcgctgtccgtcacgatgattctcgtcacccgcctgatcggaaaaaccaaaaaaagacgccgttaaaaggcgtctttttttgaagaattaactaaaaattctaattttactctgttatactgaacaacatgatcataaggtgaaaggaaggctgatgaatgaaacaggcaaccgtgtttaaatatgaagcgtttaccgatattcctgatttgggaaatcccgcaggaatcgtctttaacggagatgattattcagatgaagagatgcagatgatcgccgaattggcagggtacaatgaaacctcatttctctgcaaaagcggagaagccgatctgcgcatccgctattttacacccggccacgaaatgaatttatgcggacatgctaccgtcgcctctctttacgcattaattgaaaagggaaggcttcaggctgatcagacatatcaaattgagacaaaagccggcattcttcccgcaaaagccgctgaacgaaacggccgggtatacatcacgctcaaacaggcacccccgcaatttctgccgtttacgggcgacaaagaaaagcttgcggcctcgctcgggattacggctgaggattttcacagcgagctgccgattgtttacggatcaacggggatctggacactgattgttccgctgagatcacttcaagcatcacggaatatggtgccggaaaacgcacaattccccgctgttttgcgcgatcttccgaaagcgagcgttcatccgttttctctggaaaccgttcatccggaaagtgatctgcacggacgccatttttcttcccctttctccggaacgaccgaagatcccgtcacgggaaccgcttcaggcgttatggcggcctatatgaggcaatacggaggctctgaagccgaatgcctcacgattgaacaaggccacgaaatcgggaaagacggaaaagtggaaatcaggattacagaagataacgaaaagatgaaaatcgagatgacgggaacggccgtgtatgccgaatcaatcaattttcagcttccgtaacggtttacaagagacggtcgtatccgttatattataaatgataatcattttcaattgaataggaaggtgaatcggcatgccgaaaaccgaacaactacagcaaaacgaaagtcttgcacatacaatcagaaacagaagatccatccggtcgtttaagccggaaaccgtaccttctgaagtcatattagatatgcttgaaacggccgtttacgcgccgaaccacagactgacggagccatggcgttttatttacgcagcaaacgaagcgggaaaagcgaagcttgcggacagctacgtctcatttttcaaaaaaataaaagatgatttcaacgaggaaaaagagcggaacatgagaaaaaacctcagcgccgttccgggatttttgcttgtcgtcttaaaagaagatgaaaatgaatttacgagaaacgatgatttcgcggcgctgagcggcatgattcaaaaccttcagctgctcgcacatgaaaacggcatcggcatggtctggaaaagcggccgcatcatgtatgacaaacaggtgcaccaagacttcggccttgcagacaatgagcgcttcgccgccatcattcaaacgggctatccggatgaacagcctaaggcgaaagaacggacgccggcaaaaagcctgtttaccgagttgtaaaaaaatccccgtctctatacagaggcggggatttcgtattagcgggttttgcttttagctctgttgtcagcggctttcatccgcgcctgcgcttcgcggtcagcggaatcagcaagctcgcttgaatattcctcgtacgtgccgtctgtttcgcgtttcaaagcatccggaacttgaggaagtttttgtttgtttttatcacggtttttgtgagtatgatttctgcccatatcaatcgccccctgaaaaaagtgatatcaaacaaacatagtatctgcccggtcccgatttttattcagtttatttccgtttggctgctctttccgcttttttgaattcaccggaataaaggacttcctgcatttttttcagattggctccctgctgatgtttttcgcgcttcttttccataaaagaagaccctccttcaaaacagaataccaataggattggcttttatttccgtttttatgcagataagagatcctttaaagccaactcaagttcttcatacgtaaattgaaaaccggatgtcagcgcctgcttaggcagggcgcgctggccttttacgatcagcaggctcatttctcccaaggtcttctccagtaaaaattccggtacgggaatccaatgggggcggtgcagaacgcttgcgattgtctttccgaattgcttcatttctacgggattcggcgatgtcacattcatgggaccggacaagtcatcatgctccgccgcaaaagcaataagttccgcggcgtcatcgacatgaacccatgacagccactgccgtccagagccgacggtgccgcccgctaacagcttataagggagaaccatgagcggcagggcgcctttttcaccgagcatcacgccgaatctggcatataccgtccggatgccgagcgcttcaattttctggccttcacgctcccacatatgagccgtatgactgagaaagtcttcatttgacgtatcggactgctcagtgaacgttttctctgtgcttgtgccgtaaatgccgactgcgcttgcctgaatcaaagcccggggttttttcggctgctgcttcataatccgtctgacttctctcgtcgcttctattctgcttgaaatgatttgttctttcgttgtgtccgtccagcggtcaaagatggatttgccggcgaggttcacccatacatcaatagggggaagctcgcgctcaggcgccgcgttttcggccagccattgaacatatgtcacatttttttgttcggtttctctctgttttcttgataaaatatagacatgatgtccccggcgggtaaacacacctgtcagatgccggcccagaaaaccagtgccgcctgtcatcgcgatattcatatccatctctccttacacgttgatacatatactgtacctcatttgctaaaaagaaaacgcctgaacatcggggcgggaaaggagaccgggatgccgtttattacaaaaatatcgacccaaaagaaaaataccgagcgcttcaacatctttcttgatgagaaatatgcattcagcgtcgacgccgacgtacttgtgcgttttgacctgaaaaaagggaaagaactggacgagcttgacattcttgagatccagcacggcgatgacgtgaaaaaagcctttaaccgcgccgtagaatttttatcatatcggatgcggtctgaaaaagaagtccgggatcacctgaagaaaaaagaaacaccggacatggttatttctgaagtcatccataaactgtacgattaccgctacttaaatgacaaagaatttgccgaagcctatgcgagcacccacaaaaaaacaaacggcaaaggtcctgacgtcctattccgcgagctgaaagcgaaaggaatagacgacgataccatcaaggagacgctcagcgcgtttacatttgatgagcagatacaagaagcgttgaaacatatcggcaaaatcctcaaaaaagacaaaaagctgtccacaaaagagatcagacagcgggcgcagatgcagcttcagcgaaaaggtttccctttcgacgtcatcaatgccgctctggagcagacggagtatgaaaatgatgatgaagccgagatggaagctctgaaggctcatgcggaaaaagcgatcaggaaataccgctatgacggcagctatgaaagcggaatgaaggtcaaacagtacttattcagaaaaggattctcgattgacgatattgatcaattcttgcaggaagaggagtaaactgaaatggacaaacgatacagtcaaatgacgcctcatgaactacagacagaaattgcgggactgacggaaaaagcgcgaaaagcggaacagatgggcattgtaaatgaactggccgtgcttgaacggaaaatgacgatggccaaagcttacatgctgaacccggaagactttcggcccggcggggtgtatcagatagaaggttctgatgacactttccgcattgattacatcaacggcgtattcgcctggggacacagatcttccccgtctgacggggaagaagcactgccgatttccgttttaaaagaaaaataataacaaaagaggccggttccggcctctttttcttttcgggcacattcgtttcagcctttcagtaaaaaatgattgaattcatttttgatatcttttaagatggaattcgttgttttttaataaaaaggaggcgatttgcgttgaatatcaaaatgaaacagccatctgtgaaattaatgatttttgttttaatgatttgcacattttccatcgggtatacggaatatgctgtcatgggtattctgacgtcgattgccgatgactttcatatacatgtatcttcagcgggcatgcttgttacggcgtacgcggcaagcgtctgtctgacgggcccgatcgtaaccattatcgcggttaagctgccgagaaagccggtgctgctagggttgatgggcatcttcgtccttgccaacctgatgagcgtctttgcgccgaacttcgccgtgctggcgatttccagaattttatccgcatccattcacggagccttttttgcgatcgccatggtgtttgcgagtgaaatggtgccgcctgaaaaacgttccgccgccgcggcttccatgaacggcggattaaccgtggcgctgatgctcggcgttccgttcggctcttatttaggggatgcccttaattggcgtgccgtctttttcattatttccgttttaggcctgatcgggctgatcggactgatgctggtcgtaccgaaccggaaaccgaaagtgattccgatgctgatgaatgaatggagtgtctttaagcataaacaagtgattttttcctttgcgatcaccattctcggctactcaggcgtatttatcgcttacacgtttattgagccgattttaagagattcagcggggttcggcacagtcggcatcacaggcgcgttatttgcctacggtctcggcggagtggcggggaatttcttcgcggggaaagtgccgctcaaactgctgacgcgcacgatgatcggtgtgatgatcggcctgatcggcgtcttggcgattttcccttatatcgctgtctttcccgccgccgccgtttcagcgacatttttgttcggcgcatgtgcgttcggcacgccgccgcttttgcagaccaaggttatttcttcctctgaaaacggcacgacaatagccgctgcggtgagcgtttccgcctttaacctggcaaacgcgctcggcgcctggatcggcggattgattctcgggggaacgggatcttactcatggctgtttgccggcggtgcgctgatgacggctctcggccttgtgctttccacgttcgctcatctgtctgagaagaaagatgtttatgaataccaagtgcataaaggataacaaaaagcttgcaggggatattccgcctgcaagcttttttcagtgtttcaatgtaaaactgatcaccgtatgtttatcactctcagctaaggaaatattccgggtttccggtactccgtctttttcaaaaacgacggcataggttcctttcgcgccgcttttccatgcaatatcgccgtggtgatcagtcttgcctattatctctccgcggtctatattcggctgatgatctgactccgccgctttcatcacggtaaccgtcacaccggccgccggtgaaccgcctgcatgctcaacatggagcgtaacgggcattgcctttttggcggcggaatcatccgctttgccgcatccgcataaaacggccgccgcgagaaagataacaaaagctttattgatttgaccaatattgaatgttgtcgaatacactgtttgtcacccttgttcccagattgtaagacgacccgccgtttgtatgaatggcaatggcggtctggccggtgtcgctgtaattgcggtaaacgggcgatccgctctggcagccgaacgtatctgtcgtgtaagtgagtttatatgtctcggcagaacgtatcggcttgctgtccgaccacatggaaccggacactttgtcgcacggatatcctgtcacggttgaggaaagcccggccggactggaactgttggtcgtccggtagccgtaccagccgacagtattcccgggcgatccgtttactttgattgcgccgtaatcatagtttgtgtcaccgttttctgtccaccctttgacactgtagaatgtcttgcctgaataagagccgtacgggtacgatgacccgttgcggccgggagctgccgtaattttcgatgcccagccgtttttctgatcatacacgcaatgtcccgccgtaacgatcgtgtcggcattgacaaaaaaaccggtgcatccgtaggtgcttgtgctgccgctgtatgtaacggtcagctgtgctgtcgcgcgatatggaaatgatgttgtgggagaaattctgattcgttcgtctgtcccaataatactggaaggctttaatgacttgatgtcagctttgctgttttgtgcaagctgtcttttggtgaggcccgttccttcataagcgggggatgtctgtgttgtttgtacaggctgattctgatttgcgtcaaactcctcaccgctgtttgatacagatgtctgcgggctgcccgctgcttcagctgaaacagcaaataatgaaactgacagtaagaatgcggtaaggctcagcaatcgttttgaaactgtcttcattttataaaacccctccttttttgtctaccggctttcgttttaacatttaacatattatggaatttatttagcgttatgaccgcaagaggatgttttttttcgcaaaaaaaaagaccgggtcattcccggtctcttacggtgtgtgttatcgtctgcctgaagctctcatgcgctcttgcgggtgcgaattaattgaaccgtccgcccgtttagaagcgtagtcatcctttgcccgcggttcgccttcaaacttattattgttctgattaggaaatccttttgccttgttccggaccatttgttttccccctcggccaatatcaaaaggttgcgccttctggactgaagacgtaaagttagtatatgcctgtgacgagctgcgtaaaagcagcaggttttcccaaggaaaggagacagagacatgaatacatatatcgacaaactgacgaatttgctgcttgagaaaaatgacatgctcagctatttgcaagcgcgaacttgggttgagcttttatggggagatttcgaagcgacttacgcaaaagccggtcgcccgtatcaaggagagcaaatgacggaacgcgtcgtcaaggaatggatcgaatcatacggcagcaagctccatatgttccagagcgttcgggaagacgtttctcattatttggatcaaagcaggggtctcctgcattaatatagcagtgcgcccgccggataccgtccggcggttttttctttttataaaagaaatgggaaaatcatgtttgacgaccggcggaatgtggaaatgtgtaataacttataaaatagcggggaggaaccacaatgaacatgaaaaaggggttaaccgcatttattccggccgcaggactttgcttatttttagccgcaggcaccgttttttttgatccggcagcgaatgccgcagcagttcaccagacaaaaatagacaccgcagcagatacatatatcgtgaaagcaggagaacttaatgtccgcaaagaacccaataaacaagggcggattatcggcacgcttcgttcagaggattccgtaaaggttaaacggcttcaaggagcagattgggctgaaattgactacaaaggtcacaaagcctatatttccacgcattttctgatgaagcagccggtgaaggcggtgaccgcgaaacaaaccgatttttatacgccgactttggaaaccggcaaaaaagggtccgttaaagcgggtgaaaccgtcaatgtgctcggctgggggttcagccatgacggagggtttgaccgtaaatgggcgtacatcacatacggcgggaaagcaggttatgtgaaaacggccgacttaactcaaaaataaagattcaggcaggcgaatgagcctgctttttttctgaaacttttcgcctttcctttcgtaaaagatgaaaaggagagtgatggatatgataatggtgatcggcggccttctgatggctgcggccggcatttcagtcacattttttccgccgaagtcgatcaacagcctgtacggatatcggacgaagcgctctatggcggatgagtcgcagtggaaagaaggcaatcgattcagtgcgctcctcatgattctgttcggccttatttcggcggcagctggattttcgggcagcctgcttatcaggatgactcagccgttcgccctgattgttcaggccgtattgttgattgcgatcagcgtactgatcatcgtcttaacagaaagaagattgaaacaaacggggaggagaatcgatgaatgacattacgtttcacatgatcgaaacaaacggagtgacgctgcacacggcttcagccggtccgaaagacggtcctctggcggtgctgctgcacgggtttccggaattctggtacggctggaagagtcagatcaaaccgctggcggatgccggataccatgttgtcgtgcctgatcagcgcggctataatctcagtgacaaaccggagggcattgaaaactataccattgatacgctcagagacgacattatcgggctgatcactcattttacagatgacaaagccgtcgtcatcggacatgattggggaggagccgtggcctggcatttggcatccacgcggccgcaatacgttgaaaaattgatcacggtcaatatcccgcacccggcggttatgcggaaggtcacaccgttctacccgccgcagtggaagaaaagctcttatatcgctttctttcagcttccggaaaagcctgaacggagattgtctgaagacgattaccgcgtattggatcacgcgatcggcttatccgaacgcccggcgcttttttcacgggaagatgtcgacagctacaaagaagcatggggcagaaaaggagcgctcacggcgatgctgaactggtaccgggcgatcagagccggcggtttaggccctgccgttccgcttaaaatgcccgttccgtaccggttaatatggggcgtcaacgaccgcgcgctgagcaaaaagctcgccaaggaaacaaaacggatgattccaaacggcgacttaatcttcatagatgatgcctcacattgggtcattcacgaaaaaccgcgcatcgtcagccatttgattcatgaataccttcagcaataaagtctgtcccgcgtacagactttttcttttttttctcatatctgccgaaaaacatgacaaaatataaaccatatgcagaaaaaaatttctttccctgtaacaaaaaaagggtttaaacgtcattaaaaaaaggaaaagccttactgaagttttgcggacaattcctttaaggccgtcctaaaaaaagaataatacaaagaaggtgccttcatgaaacaaaggttaatctcaattattattccgtcttacaatgaagggaacaacgtcaagctcatccatgaatctttaaaaaaagaatttcagacgattcattatgactatgaaattttctacatcaatgacggaagcgcggatgacacccttcagcagattaaagaactggccgccagaaaccatcgcgtcaaatacatatctttttcccgcaacttcgggaaagaagcggccattctggcaggatttgaacacgtgcagggcgaagcggtaatcgtgatggacgccgatctgcagcatccgacccatctgctgaaagacttcattcaaggctatgaagaagggtatgaccaagtcatcgcgcagcgcaaccgaaaaggggacagccccgtgcgttccgtgctttcttccctgtattataaatttatcaacaaagccgtcgaagtggacttgcgtgacggggtcggagatttccgcctgctgagccggcaggccgttgatgctcttttgaagctgagtgaagggaaccgtttctcgaaagggctgttctgctggatcgggtttgaccagaaaatcgtattttatgaaaatgtcgaaaggaagaacggcacgtccaaatggtcattcagcaatctgttcaactacggaatggacggtgtcgtctccttcaacaacaagcccctcagggtatgctttttcaccggtattctgatattgcttctgtcgatggtttatattgtaacgacctttgttcatattctgacacacggcgtgtccgtacccggatacttcaccattatttccgccgtgctgtttttagggggcatccagcttttgagtctcggcatcatcggagaatacatcggccggatttactatgaaacaaaaaaacgcccgcactatttaattaaagaagcgaatataacgtacggagaacaaaatgaaacgaattatacaaaaaagcgcaagtggaaccattaaacagccgccgctgtgcgcagggtctggggacgttgtatgaaaaaaaataaatggatcttgccggcagcctgtgtgctggctgcggcagccgctcatatttttttcttaaaagagtggtcggcaggccgctatatgacggggtctggagacgggatcgcccaaatggtggtcttcaaaaagctgctgtttgatcaatatatgaacggcaggctgttttacagctattcgttcggactgggcgggggagtgtacagtcagctcggctattatttctctacttcttttctattcctgtttatctccgccgctgtccgctttttgcagcttattcagctgacgggtgaggctgatgcgctgttttgggcgcaggcctccgtttttatcagcatcgccaagcagagtttcatcatattcacggcggcttgtgtgttccgctatttcgtcaaacggacggtgcctgcttttgccggcgccgtgttgtacggggtctcgattatctacttccggcatgaggtgtattgggactttttcactgacagtatggtgtggctgccgctgctcgtgctcggcgcggaaaaaatcatcaggggaaaaaagccggcgtggtttatcttcgcctgtgcgctgacattgatcaacaacttttattttgcatatattaatctgattttcatcggcatttacatcttattcagatggatcattcatcttgaagacaatgaagccaaaaagctcactcaatgcagaatgtttattctgtcaggtctgctcggcttcggcataagcgcagtctcctttatccctgtcgtatacggatatcttcataatctgcggccgccgtattcagagcaaattgcatggcttgatttttccgacaacattttattttcaagccggataatcattctgccggcggtttttttgctttttctatttacattttctttatataaaaaccggctgttccggctgtttgcgggaatcagtctgctgtacattctgtttcacttcagtccgtttgcggcaagcgcctttaacggtttttcagctccgcaaaacaggtttgaatacgtcctgtgcttcacgattgccggaacggttgcagcagggctttctaagctttcagacatcagcatgaagagtatgctgatatccgccgtactcgccgttctgctctattggagccaagtgagacggttcagcctggatatttctgatcaggccaacctgcctatcctgctccttctggggctgaccattgccgctttccttgcagcaaagacaagactgaaaggcgcggtgcccgccgtctatgccgtcattctcttgacggcggtgctgacggctaatacatatgaaaaatatgcgttatcagaaggcgggaagatttatacggtatcgcatacctttatgacgggtcctgactataagggcaaagaacaaacagagcttattcagcgtctgaaagaaaaagaccctgatccgtttgcccgtttggattggatgaacggtgttttcaataacaccccgatcatatacgggttcaacggattcagcgtatactcaagcatactgaacagcaatctgctgtccttttactggaacgacctccggattgacatgggcagagaaagcgtcagccgttatgcgacattaggaaacagggctaatttatacagcctgctttacggaaaatattatatgacggaaaaaacaaacgaggccggcgtgccgtacgggttcaaaaaaatcatggaatcatcccattatgcggtttatcaaaatcaatatatgcttccgttcgtacggacagctgatcgcgtatataacgaggacgatctgaaaaaagcgcccgcccttgccagagaacgggcaatgcttgacgggatcatcacggaatcaagcacagccaacacgaaaaaagcgcctgaggcgaaaaatatgatccgtcaggcaaaggtaacggccgaccatgcggattatcaagacggcatcctgacggtaaacgaagacggcggcggcctgatcattacgccgcaagccgctaagatggacggcggcgattattacgtcagcttttatttgaagaataaagcgaaggaccagggctttacattaaaagtgaacgattacatgacaacgagaaaatcgaatcgatccatttacaaaacaggtgtcaacgatcttactgtcagagtgccgaaaacaaaaaacatccaaatccgtctgccgaaaggatcgtatcagcttgacagactggcgctttacgaagaacggtacgatacgctgaaaaacgcataccgaaaagcggaaaaagaaccgcgggccgatctcagatggcgcggaaatacgcttcatatctcgtatgaaaacaaaacccgcgcgccgtatagcatgcttccgattccatatgaaaaaggctgggagctgaagataaacggcagaaaagaacagattgaaaaagcggattattcctttatcggatttaaagcgcaaaaaggaaaaaacgatattcaattaacgtattacccgccgttttttaaacccgcggccgctctatcggtgatcagcctcgtgtttgccgctatatatgtgagaagacaaaaaaagcccggctcttaaacagagccgagctttaattttttctgcagtttttcctcgctgaaaatccagcccgtgtaggaagagagaagctctaaatcatgattgaggtggacgatggcgacaaaaggatagtggcctttgctccggtagcgcaaatcaataaagcgcacctcataatgatctttaaaagtatcgacctcccacctgtaaacgggggaaaatgaaagaaaggctgcaatattttcgtcctgtttcgcggccttcatcacatcggtttccggaacgggcactcggttgaatgtatccaatatcacgacatggccgtcaaggcttctgccgacataaaaggcatgcgccgtcgtcacggcgatacgccactgcctgaatttcatcgtcggcgaaataatgatggtttcaatctcctcttcaatcatttcgcgcagccttcgctttatccgcagctgcatcaaaaaccggacggcgtaatatcctgcgaggatgatataaagcatcagaaatgtcacgcccggatgacctccgatataccacacggcaatcgcggccaaatggctgacgaaaataaacggatcaaaggtattgattaaaccgagagcgatccattttctcgaaaacgggcggatggcctgtgtgccgtacgcgttaaaaatgtcaacaaacacatgcaaaacgacagccagaagcgtccacagccacaggtgcaaaaagttcgcttccggataaaacataaacaaaatgcccggaatcagaacggaccaaaataatacggcgggaatggagtgcgtgaatcctctatgatttcgaatataaacggcattatttttcagcttcaatatggtatcaatatcaggtgcctgagagccggcaagcgcggcgatcataactgcctgagacatgggggtgtgcatgccgacggcaggatcaagagttgcgattccgccaagcgcgatacccatgacaacgtgagtgccagtatccattgttgacctcctagcaggcgttaaaaatcagccgcccgcatatttcgcattataagatattccccattttctgtttgcccaatcatggcgtttatccgccgttctcatatgtttccgctttttctttatcactatttaatgtaacatattatcgtaacgtgcccttagtttacaccaaaatacagtgtcaagaaaagcggaacccgaaacatctgaggagaagatatgaacgcacttgaagaaaaaatgaaacaaaaagatatagacaaatttcgcgaggacttaattacatggttcgaaagagaacagagaattctgccgtggagagaaaatcaggacccgtatcgggtgtgggtgtcagaggtgatgctgcagcagacgcgcgtagataccgtcattccttatttccggcggtttgttgagcaatttccgaccgtttcggcgctcgctgaagccgatgaggaaaaagtgctcaaagcctgggaagggctaggttattactcccgtgtaagaaatctgcaaagtgccgtaaaagaagtgcatgagcggtacgggggagtcgtccctgccggggaaaaggaatttggcggactgaaaggcgtcggcccttatacaaaaggcgccgtgctcagcatcgcatacaacaaaccgattcccgccgtagacggcaatgtgatgcgtgtcatgtcgagaattctttccatatgggacgatatcgcaaaacctaaaaccagaaccattttcgaacaggcggtatccgctttcatttctcatgaaaaaccatctgaattcaatcagggtttaatggagctcggcgcgatcatctgcaccccgaaatcgccgtcatgcctgctttgccccgtacaaaagcactgttcggcatttgcggaagggacagagcgggagctgcccgttaaaagcaaaaagaaaaagcccggaataaaaacaatggcagccgttgtgctgacagacgaccaaggcgatgtctatattcataaacggccgccaaaaggcttgctcgccaacttgtgggagtttccgaataccgaaacccagaaaggaatcaaaaccgaaagagagcagcttgaagcctatttagaaaaagagatgggaataaccgctgaaatcggggagctggaaggcatcgtagaacatgttttcacccatctcgtctggaatatttcggtctttttcggtaaagtaaaacaagtgtcggatacaacggaattcatacgggtcacaaaagaggagctcaaggaatacgcatttcccgtttcccatcaaaagatatggaaaatggcggaagaaagcggccgctaaagagcgtcagtcatagctgacgcgagtgccgtggccgtaatccgcttcattccgtttcagtccgccgcgggcttcgatttcctgaatcagttcccggtatttggactggccttcttcgtttaaatacggcataatttgctggaaggcatgatggaaataggcgagctctgaatctctccaatcttgtttgggcatcatggccaattcgcccatatcacgtccgacatacatataaaagacccctttcaacacatattgcttttattgtttgttgaatgaaaagaactatacacagcaaggagctgaggaaaaatggaacaaaataaatgcgcactgatcacgggaagcagccgaggcgtcgggaaagcagccgccatcagactcgcggaaaaaggatacaatatcgtcatcaattacgcccgcagtaaaaaagcggcattagaaaccgccgaagaaattgaaaaactcggcgttaaaacgctcgtcattaaagctaatgtcggccagccggcaaaaatcaaagacatgtttcaccagattgacgaaacattcggcagactggacgtgttcgtcaataatgcggcttcaggcgtgctgagaccggttatggaactcgaagaaacacactgggactggacgatgaatatcaacgcgaaagcattgcttttctgcgcccaggaagcggcaaagatgatggagaaaaacggaggcggccacatcgtcagcatcagctcgctcggcagcatccgctatcttgaaaactatacgacggtcggtgtctcaaaagccgctttagaatcgttaacccgttatctggcggttgagctttctccgaaaaacatcatcgtaaacgcggtgtcaggcggagcgattgatacggacgcgctgaagcatttccctaacagagatgaactgctggaagatgcccgccaaaatacgccggccggcagaatggtcgagatcaaagatatgatcgacacggtggagtttttagtttcttcaaaagcggacatgatccgcggccagaccatcattattgacggcggacgctctctgctcgtataagttttaaaaaagatgaatagccttatcgtctcctgcgcattctaaagtgcgtggaggtgataacaatggcaaactcaaaatacagcaaaacagacgttcagcaggtgaaaaaacaaaaccagcaatcagcttccggtcagggtcaatacggcactgaattcggcagtgaaactgatgcgcagcaggttagaaagcaaaaccaatctgctgaacaaaacaaacagcaaaacagctaatcactgaaacgaaaaagcacttcatcttcggatggaagtgcttttttctgttgccaaaacgacaaaacttgtgattcctctacagaatgagtcaaagggttttccggcgtaaaatcgaaatggtaaggagtatcaacctaaaagcctaaggaggaacccgatgtcagagtttgaaaagcttgtaagtgaacagatgaaaatcatggatcagcttctcgagctgcagtcagaacttgaccgctgccggcaggtggaagcggaactcatcagtctggaaagagatgcaaagctggacaatgtacaggacgaaattgcgacaaagcgaaaagacctggccggcatacaggagttattccaaaggcagacagagcaagtcatccagtcttatcgcagcacggaaaagccgtcttcctatgtgcagaaatgaatgtgccattccggaagcggagtggttcttttattttcattttttaattcgtaacgttataatagtgaaaagacttgtcggaaagcaattgcggctgcattgactgcagggctttacagaaagtaggggagaaatatgggatatcccaaggaaggagaaaccattcaaattcacagctataagcataacgggctgcttcatcgaatttggaatgaaacgacgattttaaaaagtacggaattgtgtatcatcggagctaacgaccggacaatggtgacggaatccgacggacggacgtgggtgacgagagaaccggcgatctgctactttcatgcccgtcagtggtttaacgtcatcggaatgctgagagatgacggggtacactattattgcaacatcagctcgccgttcgcttatgacggagaggccatcaaatatattgattacgatttggatgtcaaggtgtttccggatatgacatataacattcttgacgaggatgaatacgatgaccaccgcaaatcaatgaattaccctaaagagatcgacagcattctgaaggagtatctgaatacgctgctgcactggattcatcagcggaaaggaccgtttgctccggaatttgttgatatgtggtatgaacggtatctgcgctatacaaaataaagaatacaataaaaaacctgttggggtgtcaacaggtttttcacatgggctcacacgccttaaagagagaggggataaagtgtgggcgtaatcagacgctatatgcaatttgtaaaaccttataaaaaacaaatttttatcacagtgttaatcggcattataaaattctccatcccgctggctctcccgcttctgttaaaatacgtggtcgatgacattattcaagggagcggaacggcaagcgctaaaacatcatcgctattcacgataatgggcatcatgttcgtgctgtttttaattctgcgtcccccggtagagtactatcggcaatacttcgcgcaatggacgggcagccgggtgctctacgatatcaggggggtattgttcgatcatattcaaaaattgagcctgaggttttatgccaacacgagaacgggcgaagtcatttcccgggtgataaatgatgtcgaacagacaaaagactttgtcataacgggactgatgaatatctggcttgatatgatgacggtgctgatcgtcatctgtattatgtttacactcgatgtgaagctgacattgatatctgtcattttgtttccgttatacggaatttcagtgaaatacttttacggccgtctccgaaaactgacacgtgagcgttctcaggcactcgcccaagttcagggacatttgcacgaaagagttcaggggatgcccgttatcagaagtttcgccattgaagattatgaacaagccaattttgatgaaaaaaacggacattttctggacaaagcgatccgtcatacgaattggaacgcgaaaacgttcgcggtcgtgaacaccattacggatttggcgccgctgctcgttatcgcatttgcgggttattttgtcataaacggcccgctgacggtagggacgatggttgcgttcgtcggctatattgacagaatgtacaatccggtcagaagattgatcaactcatcgacgacgctgacccagtcgatcgcttcaatggaccgcatatttgaatttatcgacgagccgtatgaactgactgataaaccgaatgcactaaaagctgacggcattaagggcgaagttgaattccgaaatgtctcgttccgttatgaggaaggaaaagaaacgattttgcaggacgtttccttaaaggtgacaaaaggggaaaccgtcgcgctcgtcgggatgagcggcggcggaaaatcgacgcttgtcagcctcataccgcgtttttatgatgtatccggcggcagcctgctgattgacggcacagatattcgcgattatgaagcgagaagcctccgcaatcaagtcggaatggtgcttcaggatacgtttctgttcagtgagacgattcgtgaaaatatcgccatcggtaaaccgggagcgtctctggatgaggtggttgcggctgcgaaagcggcaaatgcccatgaatttattatgaacttccccgaaggctacgaaaccaaagtcggcgaacggggcgtcaaattgtcaggcgggcagaagcagcggatttcgatcgcccgtgtattcttaaaaaatccgccgctgctgattttggatgaagcgacatcggctcttgatcttgaaagtgaacactacattcaggaagcgatggaaaagcttgcgaaaaaccggacgacttttatcgtcgcccacaggctgtccacgattacgcactcggataaaattgtcgtcatggaaaacggcgccgtcgtcgaaaccggcacgcacgaggaattaatggcccgaggcggccagtacagacacttatttacgattcagaatttgaactgatacaaaaacgtatgccgtccgaatgggtggcatacgtttttttgaatgcaaaaaaacccggttttacggaagcaccgggttactcttcgtctgtttctaattcgctgtctttcgggtggtatgtctgaaaactcgtaattaatgtatcgagatgctccagctgctcgcggtattccgcaaccgcagccataatgctgagcatattgtaatcaagcagttcatcctcgcagttctgctgatttttcaagaaagacttcgtcaaaagctgtttatatcttatgctttcttcagcatcgtcatcatgcggtttgatcttgccgaccgtccgcatcagaatcctttcgtgccaatgaagcagataatcaatttcttctgtcagcgtctcctgaaattcctccggcatatgataaatttcgttttcatagcggtgcagctttttcagcgtatcaagcgcccgatttgccgtaataatcgcctgtctgaataaaacaagcttgcgcgactttacatacgtcgttttcttaaagtagcttctctcctctttataaagaaggtacgtatgatcaagcttcatcattttttccttcagcttctcaatatcctctttcaatatcgagtgttccgtggactgacgcatcgtcagcctgatccatttcatgatctcatcggtatattcaaccgtatgatgagtcagcttcgtttcgtatttcggcggaagaaacacaaggttcacaataaaagaagacagcacgcctaaaataacggtgcttgttcgtatcagagcgaacgtcaggaagctgtttcccggtgtttctaaaatcgcgataaccgtcacgagcgcaatcgaaatggtgtgttcaattttcagttttaacatgatcgtgatgacaatcactgcggtcaatccgatcataatcggactcggtccgaaaatcagtccgaataccgtagcgatgacagcgccgatgatatttgcctgaacctgatcaataatgataagaaaagacctgtaaatagagggctgtatggcaaatatagctgcaatcccggcaaagatcggcgacggaagtccgatccatgatgctaagtagagcgcgagcgtaatcgcaatccctgttttaaaaatgcgggcaccaagtttcattggtttgtgcgtgcattcctttctctaataaattatgtgccgaacgaacggctgacacttacatttccctgtcggctgatttgctaaacaataaagtaatatacagggatcataccaattattcaaggtctttttttgaaaaaaccattatctcacaaatcggacaaaaagaaaaagcggaagccccgggctcccgcttgtttcagcagttattttttcatatgtctgaacgcatcttcaacggcttgtaaagtggcgtcgatatcctcttcagtatgtgcggttgtgataaaccaagcttcatacttcgatggagcgagattgatgccgcgttcaagcatcagcttgaagaacttggcgaatgcttctccgtccgtattttccgcctgctcgtaattgacgatcttttcatcagtgaagtaaaccgtgagcgcgccttttaaacggttgacggtgatggtaatgccatgtgtctccgcatgggcgagaatgccttgctcaagtctggcgccgagctcatcaagccgctcgtaaacgccttcttccttcagcacttccaggcaggcgatgcctgataggatagatgccgggtttccggccatcgtgccggcttgatatgccgggccgagcggagcaacctgctccatgatctcttttttgcctccgtaagcgccgatcggcaagccgcccccgataattttaccgagcgccgttaaatcaggcttcacttgaagaagatcctgcgcgcctccgtacataaaacggaacgccgtgatcacttcatcataaatgacgagcgcgcccgctttatgggtcaactcatttacctgttctaaaaatccttcttcaggttcaacgatgccgaagttgccgacgatcggctcgacgagaaccgctgcaatttctgaaccccatttatccagcgcggctttgtagctttcaatgtcattgaaaggaacggtaatcacctcattggcgatgcttttcggcacgccggcggaatcaggggtgccgagcgtagacgggccggaacccgcagcgacaagtacgagatcagaatggccgtgatagcagccggcgaatttaatgatttttgtccggcctgtataagcgcgtgcaacccggatcgttgtcatcaccgcttcagtgcctgagtttacgaatcgtactttatcaagtgaaggaatggcctccttcagcattttggcgaaagtgacctcatgtttggtcggcgtcccgtacagcacgccgttttcggccgctgttttaatcgcttcagtaatatgcggatgggcatgtccggtaataatcgggccgtaagccgctaaataatcgatatactgattcccgtctacatcccagaaataagcgccattcgctttttccatcgcaacgggtgaaccgccgcctaccgctttataggatctggacgggctgttcacgcctccgacgatatgctctaacgcttccttatgaagttcaactgattttgtatacaaaaaatgaccctcctaatatctccttacatcatgttctattgtagcatgcttcattgcgagcacaacggttcatgcttccagaaaagagcggggggataacggttgtaatcttaacgtgaattggatacgcttaataaaaaacccggaggtataagaaatgacgattgaaatcggacaaacagcaccggatatgaaattagtgaatgacagcggggaagaagtagcactgacggattttaaagggaagtacgtcgttctctatttttatccgaaagacatgacacccggatgcacgacggaagcatgtgatttccgtgatcagcacgaaagtttcgcgggacttgatgcggttatcatcggagtaagccctgacagccgtgataaacatgaaaaatttaagcaaaaacacgatcttcctttccagctcctcgttgatgatgagcacaaactggcggaagcttttgatgtgtggaagctgaagaagaattttgggaaagaatatatgggtatcgagcgatccacttttttgttagacaaagaaggccgtcttgtgaaggagtggagaaaggtaaaagtgaaagatcacgttgcggaggcgcttcgcgaattggaacaaattgcgtctaattaatggacaaatgctgaactcacggggttttcttcagattacatttgacaggagaccggaaaaagatgtacactaattataaacattataaagtaagaatcttttttagaagagaggtgcatgacggatggctgcacatgaattaaaagaagccttagacacgttgaaggatacgggagtccggattactcctcaacgtcatgccattctggaatatctcgtggattctatggcacatccgacagcggacgatatatataaagccttggaagggaaattccctaatatgagtgttgcgacagtgtataacaatttgcgtgtattccgggaagcggggcttgtaaaggaactgacgtacggagatgcgtccagcagatttgactttgtcacctctgaccattatcacgccatttgtgaaagctgcggaaaaatcgtggacttccattatcccgggcttgacgaagtggaacagcttgctgctcacgtcacagggtttaaggtaagccaccaccgtttggagatttacggcgtctgccaagaatgttccaaaaaagaaaaccactaaacgaagctgaccgctttgatacggtcagcttcgtttattttacactgttttttctgttataagactcatcgaacgcttggccttccaatcctttatccaatgtaagcggctctctgcaatgcatgcacatatccactctgcccagaatcttcgtttctttctcgcaagcggggcacatcacccggaccgcttttgtggacagcatgccgatccaaaaataaacggcggtgctgagtccgatcgacagcaggccgagaatcataaacaagctggcaagcaaaacagactgcttaaagaacagcccgatgtacataatgataaacccaacgaaaaccaaacttaacgcaaacgttctgatcttattaattttgcttgagtatttcgccatgtccatccccctctcgtttaactatagcacaaaacagatggcatattcttcatgttttcgtaagaaaagggaagaataaatatggcacctgaaaggaaatttgttataatagtgcaatgtgtttagaaaaaaggactttcatgttttatcatagaaatgtagaaacaatagctagtgaaacaatcgcattggaggaatcgtaatggacaatcttctccgtccaatttaccaagaaagagcaagtcatcccgatacgctggccgtccttatgattgagagaaggagtaaagcatcatccatcacggataactttgatgcggtcatgcttgtcattgtcaaacaggctgatgaacctctttttataaagcattatgaattcgaacacaaaaccgcttctttacatattgtaacggatgctctgcttcaggaatggattctgcttgggacaaatagaagagtcatagattggatcatcaacggtaaagtgctgtttgaccgcaatgaatatatatctgaactcaatgaccggctcagcacttttcctttcgcggagcggaaattaaagatcggaatggaatacggcaagctgatcagaagatttgtagaaggaaaagcgttttttgaagctgatcattttctggatgcatattatgcggtagtgcatgctcttcaccacttggcccgcatagaagtgattgaccgggggttttatcccgaaacgacagtctggaaccaggtccgtcacattgagccgcaggtatataagctatattccgaacttgtcgagagtcacgaaagcttggagaaaaggcttgaattattattcttagcaaatgattttctcatccattcaaaagctgaaatcggttctgcgcacctttttcaagtgatgaaagaaaaagaaatgtggcagtttggagaattgcttcagcaccccgaactggtgcacttcacccaagatctcggtgtcatgcttgattacctgacggaaaaaggctttgttgaagtatctcaaatagagaccaaagggcaggaagtatatcatcgaggatattctttcaaaaaaagtgttgacgctgaatcataggcatggtatattattaaacgtcgctgatgcgcttcaacaaaaagctcacagcggcggagaaataaaaacaaaaaacatttgacagcaaagcgctgaaatgttatactgaaaaagtcgcctcgagatgaggttgagatgatctttgaaaactaaacaagacaaaacgtacctgttaattcaaagttttaaataaatcgcacagcgatgtgcgtagtcagtcaaactaaggtctgcatgatgcagatcacacagacgttactgcaggatgcagtgaacttagtctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcctacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccatagaaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgctttctgttatctagttttgagagaattttttaaaaaaactcttgctttttctgaaatacatagtataataatacatgtcactaaaacgtctggtgatgatggcgaagaggtcacacccgttcccatgccgaacacggaagttaagctcttcagcgccgatggtagtcgggggtttccccctgtgagagtaggacatcgccaggcagacttcattccgcagtagctcagtggtagagctatcggctgttaaccgatcggtcgtaggttcgaatcctacctgcggagccatttatggagagctgtccgagtggccgaaggagcacgattggaaatcgtgtaggcggtaaccccgtctcaagggttcgaatcccttgctctccgccactaattatcaatacataacaaacgaaaaaataccagggcccgttggtcaagcggttaagacaccgccctttcacggcggtaacacgggttcgaatcccgtacgggtcacttatatgatggaggattagctcagctgggagagcatctgccttacaagcagagggtcggcggttcgagcccgtcatcctccaccattatcatcgcggggtggagcagttcggtagctcgtcgggctcataacccgaaggtcgcaggttcaaatcctgcccccgcaaccaaaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttgccggtctagctcaattggtagagcaactgacttgtaatcagtaggttgggggttcaagtcctctggccggcactctaaatgatggaggggtagcgaagtggctaaacgcggcggactgtaaatccgctccctcagggttcggcagttcgaatctgcccccctccaccattttataaataggggcatagtttaacggtagaacagaggtctccaaaacctccggtgtgggttcgattcctactgcccctgccactatattatttattcatcttcagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagttgcattttttaaaaaaaacagcataagatgtaataagttctttttacatgttgcggaagtagttcagtggtagaacatcaccttgccaaggtgggggtcgcgggttcgaatcccgtcttccgctccaattacggcggcatagccaagtggtaaggcagaggtctgcaaaacctttatccccggttcgaatccgggtgtcgcctttctattgccggggtggtggaattggcagacacacaggacttaaaatcctgcggtaggtgactaccgtgccggttcaagtccggccctcggcaccaatttaactttgagcgaattatgttaaattggtcatcaattttcttattataaaacatatatgagagtgatttgcatattgcaggtcgcttttttttatataataaaagcgtgaagactatcaatataagtttcttgcttgtatcgtatatactgcattaccatttgaaaaaactttactaaaaccattgacactttataaaatgcatgttatatttatatacgtcggttgaacacgacgcattatatgccggtgtggcggaattggcagacgcgcacgactcaaaatcgtgttccttctggagtgccggttcgaccccggccaccggtatacaaaggcatctacatattgtagaagccttttttgttgtatgaaaatatctccaaggcttgtgaaaacatgatacctgcagcaggaggagctggattcggcgtaccgtgcttatattaaggaaacaccgattcggccgtggagtttaatctttccgatcggctgcttttgctattaacactgtttctcagctggtggggcggccattcaaaagcgatatgtttgggggcatgttaaccgcattattggcagcggttattgcagcattagctctttttatgtttcagcgctttcctgcaggcgagcttgttacccattttattaagggcggaaacgaattggtcaacgttattattatgttatcgctgatttgggccgtaacagcagtagctgaaaatctgggattctcgaaatatgttacttctcatttaacatcatggatccctcatatgtttattgcgccgtctctttttatactgggggctgttatatcctattttatcgggtcatcctgggggacttgggacgctggcggttcagttacataccagcttattattagcgatcggggccgtgtttgtgagcggaacattggatttgcttctcccctcagtgataatacggtgttggggatcgatgttgtgaagtatgcccgttcgaagcttgttccggcgcttatcgccgcagggatctccgttatgttatacgggcgtatttttcagataacaaatactttttgaaggcgttatccgaaattgggataacgcctttttaatgagctgttatacttgagaaaaaaaaagggtgatgacattgaagcagattattgcaatgggcggcggggggttttccatggagccggatcatcttgtgctggatcagtatattttagagcagtcggcgcggtcaaagccgaaagtttgttttttgccgacggcaagcggagattcggagaattataccggcaggttttatcaggcctttcaaaagctgcggtgtgagccggatcacttgtcgctgtttaaaccgccgggttctgatctcagatcctttctcatgaagaaagatattatatatgtcggcggcggaaatacgcgcaatatgcttgtcttatggaaagagtgggggcttgaccttattcttcgtgaggcttgggaaaacggcatcatcttggcgggtctcagcgccggagcggtttgctggtatgaagaaggtgtgacggattcagcgggggatttgcgagagttaagagctttaggatttttgccgggcagcttttgtccgcactatgacggagaagcggagcgccggccggtttatcaccgtctgatttccgaaaagaaactcagggagggctatgccgctgatgacggcgctgcgcttcattataaagacggtcagctgttccgggctgtctcttcccgggaaaccgcaaagggttatcgggtttttaataccgaagaaggcgttcgggaaacagagcttatgaccgtctcgttatctgaattttgataatatgcttttttttgtacacaacttatgttacgatgagagcgaaatcaatagttactgggggtgcccgtctgagcgggctgagagagaagcagcggcttcttaaccctttggacctgatctggttcgtaccagcgtggggaagtaaaggttttattattgttgatgaaaacaataatagtttctttctgactgcaaaaccgggttcttctttgaacccggttttttgtgctggtgctgagcttggttctgttattcaaatgataaaggagagatttgtatgcaaaatcaatcagtacagcaagcgaacatttccattatgtcgagcttttccggcagtaaaaaggtttatgcagaaggttcttcgcccgacatacgagtgccgatgcgggaaatcagccttagtccgacaacgggggcgttcggggaagaggagaatgcgccggtccgtgtctatgatacgagcggaccgtatacagacccggatgtacagattgatattcatgaaggtctgggggcgctccgcacaaagtggattaccgggcgcggagatgtagaagaatataacggccggaccgtgagacctgaagacaacggctataaaaaagagggccgtgccgccgaataccccggcctgcagcggaaaccgcttcgggccaagccggggaaaaatgtaacacaattgcattatgcgagaaaaggcatcattacgccggaaatggagtttatcgcaattcgcgagcatgtgtctcccgaatttgtcagagacgaggtagccagcggccgggcgattattccttctaacgtcaaccacccggaaagcgagccgatgattatcggccggaattttcatgtgaaaattaatgccaatatcggcaactcggctgttacatcttctatcgaagaagaagtcgaaaaaatgacgtgggcgattcgctggggcgccgatacgatgatggacttatccacgggaaaagacattcatacgacgcgtgaatggattatccgcaactgccccgtgcctgtggggacggtgccgatttatcaggcgcttgaaaaagttaatggcattgccgaggatttaacgtgggacatttatcgtgacacattgattgagcaggcggagcagggcgtggattatttcaccatccatgccggcgtattgcttcgttacgtcccgttaacggccaaacgcacgacgggaatcgtatcccgcggcggggcgattatggcgcaatggtgcctggctcatcatcaggaaagctttctgtacacgcattttgaagaaatttgtgaaatcatgaagacctatgatatcgctttttcacttggtgacgggcttcgtcccggttcgattgcggatgccaatgatgaagcgcagtttgcggaattggagactctcggagaattgacggagattgcgtggaagcacgatgtgcaagtgatgatcgaagggccgggtcatgtgccgatgcataaaattaaggaaaacatggacaaacagctggaaatttgtaaagaggcgcctttttacacgctcggcccattaacgacggatatcgctccgggctatgaccacattacttcagcgatcggcgcggcgatgatcggctggtacgggacggcgatgctttgctatgtcacgccgaaggagcatttggggctgccgaatcgtgatgatgtaagagaaggcgtcattacgtacaaaatcgcggcacatgccgcagaccttgctaaagggcatccgggtgcacagatccgtgacgatgctctgtctaaggcgcggtttgaattccgttggcgtgatcaatttcatttgtcacttgatcctgaaagagcaatggaatatcatgatgaaacactgccggctgaaggcgcaaaaacggctcacttctgttcgatgtgcggccctaagttctgcagcatgagaatttctcaggatattcgtgattatgcgaaggaaaacggacttactgaagacgaggccgtcaatgaagggctgaaagaaaaagcaaaagagtttgcagagaagggaagccgcttatatcaataaaagaaaagatgaagatggagagtgtccatcttcatcttttttagaaaaacggtgaacggcgaagcggcggaatgctctgctcgaagcggaatatattttccggatcatatttcgttttgacttgacggaggcggtgaacattttctccgtaatacgtttgcagccagtttctgatttctctatcaggccaattcacataatctcccatcgtttctcttgatagggacgttctcagtccttcgatccagcggacattttgtctttcttcttcagcagatgtccaagttgtaatatattcttgggcaatgattgcgttgcgatagtagaatgccgtttggtccggagcgatccgtccggccgccccgccgagagattgctgccagacactggcgttttcgttcggagcgtgctctaaatagcgctttaaagtggatattgcgcgtgttgataatggtttttcaataaaggatcctgaccgcttcatcttttgcggctgattgcctcccgggctgttaaaaaaggctgccgctttaataaatggcactgtcttgaccatgccgcttgtcggttttcccgctttcattaacggagccagcagttctttcagctcctcttttgtcccggtaaattgaccgagcgcttctatgcggttgacttccttaggccaaaactgaattgatgaggtaagccggttgtctgtaaatggagcccagcgctgccacgtgttaaatacttcctcgaaatcatcccagccccaagtgacagaaaaaacagacacgcacgagatcggcacggctttaaacatcatggatgtgacaatgccgaagttgcctccccctccgccctgagatgcccaaaatagatcagagtgctttgagcggttgaccgtgatcaagtcagcacccgctttttcgtccgctatgatcatttcgagctggaggagacgatcgcaagtcagtccggcagtccttgttaaatatccgattcctcccccgagcgtcagccccgtgattcccacattcgcaatggttcccgcaggaagggtcaagccgtaccgccagagtgtccggtagacttcccccaattcggctcccgcttcaatcgagaccagccgcttatcctcatttactcttattttcttcatttcactgagatcaatgactagtccgtcatttaacagagaaaaattttcgtagctgtgtcttccgcctctgatacggaagggcacattgttctcacgcgcccatctcaccgcattgagggcgtcatgtttgttttgacaaaacacaatgatgtctggatatctttgcaggcttaaattgatattggttcttgcagcattatagtccgggtcatcttttttgacgatgcgaccggtcaatgttgtcttttccacattctcactcactttcacttgtaatctgctatgttttctagcatatgcggaaaaatgagagagtgtatgaggaaaacccccggaaggacacgatattttaaattatagttgacaggtagggattgtatgaattaacataatcattacatatttccaaacgatggctgatcggatcaccgaaggctcttatctattaaacagataagggccttttttgcgtgaaagtcattaaatgaaaagcggagggatgaaaagtgggtttaaaaaaggtgacacatgtgcgcaaaaagagcaaaaaacggaaaaagtacagaaaacacacattgaatttcgaactgcttgtagagaaaaacaaacgggagattatgagaaatgaggaacagatggagcagatttatataaagatagatgaaaagcatgcgggggttcgataaagatgaaggagagaaaatggaggataaaaacaacggtactcgcgctgtcggtatccatcgtgttatcagggtgcgcgttagggagtgccggggaagaaccgtcatctgaggctgataaaaaggaagaaacacgtatcgcccatgtcaagacaaaggaatttaaagcttctcatccggcggcgattcccgctaaatcgaaagccagaactgacacttttgttgctgggatttccgcgccgggcggcgtgtttctgccgtacttttacgaaaacggctgggatggaaatgcgacagatcctatttttgaaccgttagtcaaactggataaaacggggaagcctgctccggctcttgcggaaagctggaaaatttccaaagatcagctaacatacacgttccgtttaagaaaaaatctcgttttcagcgacggttcaccgttgaccgcaaaggatgccgcattcactttaacactgctgcatgatcctgcatacgcgggctatgaagatatcaccacggcttatattaaaggcggtaaggcttacaaagaaggaaaggcaaagacgatagagggcattcgcgtccttgatgacagaaccattcaaattacgactgagaaagtcagtgcgaagtcgctgcttcttttgggcgggcaggtgctgtcagaagcttactacgggaagaaatatcaattcggcaaactggattatttaaaagagctttatgccaaacctctcggagcgggaccttaccaatttacagaataccttccgggacaggaaatacgctatcaggctaatgaacactattatgccggaaaaccgaaaacggaaaagctgatttataaaattatcgatccgtcaacttcccttcagctgtttgaaacgggtgaccttgattacgcttctttctcacctgatgatgatacggttcagcatttaaaaagtctcggttttgccaatataagcgtatctgtcgtgaatgattacgggcttgtatacgtcaatcacaagcgtccgccttttcaagataagaaagtgtcccaggcgcttatttacggacttgaccgtcaaaaaatcgtcgatgtccgctttaaacgctacggagaggtcgcgaatgttccggtgtctccggtttcgtgggcttatgatgacaagggtgtcaatcggtacgcgtttaaccctgaaaaagccaaaaagcttcttgatgaagcaggctggaaaacgggcaaagacggtgtacgtgaaaaaaacggcaaaaagcttgaaatcagctattacacatctaaagcggatgatgatttcatcccgatagcgaaagaaaattatgcggacatcggaatctcattaaaaccggaagtgatggattttaatacagaagtagcgaaaatcaatgacaaacaatatgaccttgccgccgtttccacctcgcagattcttgatccgaatgacacggtggaaaagctggcttccggccatcccaataatgtgacggggtattccaatccgaaagcggaccggctgatagagaaaggagccggcacgcttgatatcagcaaaagaaaagagatttatcaccagctgtaccgggagctcggggaaaacccgccttacattctgattcattaccgtcagagcgcaagggcggtcagcggaaaaataaaagggcttgagcctgataattattctggaatcagttcaagtctctcaaatgtctcaattcgatagaacggttgggcaaaatacccgatgcatcctggggattttgccctttcagcggaaaggaggggctttttatgaaacggtatgccgcagaacgattcattcaaatgcttgtgatcttattcggtacgtcctttattatttttttcttattcgccatgctgccgggcgattatattgattccaatgtaaatctgactccggaaagagcgaaggagttaaaagcgctttacgggctggatcagccgatttggaagcgttatgtgacgtggctcggaaatgtgctcagcggagattttgggttttctttgaaatatcaggagaacgtcctgtcactgcttcggaaatatgtctggaattcgttttttgtcgcctttttggcgttgcttgtcacatggtcagccgcgatgatcacgggtgtcatatccgctgtcaggaaatactcatggtttgacgggatcgtgacgtttcttgtttttgcttccatggcgtttccatctttttttatcagccttctgtttattaagtggtttggggtggatttgaaaatattgcccgtcggcgggatgattgataccggaagcacgagtacaggtttttcgtacgtgcttgaagccgccagacatatgattcttccggtcgtgattttatctatgctcggcatcggctcgctgacaaggtatttccgctccggcatgctggacgtgatcagacaggattatatcagaacggcgagagcgaagggattgaaagagcacaccgtcatctggaaacatgcgttgaaaaacgcgcttattccggccatcaccctgcttgcttttgaactgccgggactgttttccggagccatcattattgaacagattttcgggtggccgggtgtcggccgtattcagcttgaatccgtgcattatcgtgattatccggttttgatggcgtttaccttgtttttgtcttgtttaacgattgtggggaacttcttggcggatatcgcttatgccgcggttgatccgcgggtcaggctgaaataggaggtgtgcggaatgaaaaaacaaaaaggggtgccgccttctctttggaagcagacgtaccgccgcctgctgcagcataagctgacggtcatcagtcttcttttcttatgttttatgtttttattgtgctttatcgggccgtctttttctccgtacataacagatcggacggatatttcaaatgccaatcagcatccgggaatccatcactggctgggcaccgaccagtacgggagagatgtgctgacgaggctgatgctggcggggcagatttctctgaccgtggggcttgcttcaatggtgctgtcgcttgtcatcggctctttactcggggctgcggccgggttttatcggggagccgctgatatgatcattatgcgcattgctgatatgctcatgtccatcccgggcctgccgctgcttttgattttggctgcggtgatgtcggagtggaaagtgccttctgaatacagaatgtacctgattatgatgatgttaagcctgatcggatggcccggtttggcgcggcttgtacgcggacagattttgtcgctgaaggagcagccgtttatgatggccgcggaagttttggggcttagtgataaacggaaaatcctctatcatttgcttcccaacacattgccgttattactggtagcggcgactttgcatgtggcgggagcgatgctgagtgaatctgcgctgagttttctcgggcttggcgttgctccgccgacaccttcttggggaaacatgatggaagcggcgaatcattttatggattttacactccgcccgtggctgtggattccgccgggaacggccatttttctgaccgttgtggcgattcatctgcttggagacggtttaagagacgcttttgatcctaaggtaaaacggcaggtgaaaatgaaatgaaaaaaccgcttttagaagtgaggcatttggaaacggctttttatacagaggagggtgcggtaaaggccgtggacggtgtcagctttacgatacatgaggaggaaacggtttgtattgtaggagagtccggctgcgggaaaagtatggcgtcattgtccattatgcagcttattcccgagacggggagaatcgaacggggagcagtgcatttttccggacagaatctgttggaattgaaatcaaaagacatgcagaaaatccgcggcagcgaaatcgggatgatttttcaggaaccgatgacatctttgaatccggtatttacaatcggtgagcagctgaccgaaccgattcgcgaacatttgttgctgagtaagaaagaggcatggcggagggccgttgaactgatcacgttagtggagatcccgaatgccgagcaggttatgcaccgatatcctcatgagctgagcggcggcatgctgcagcgcatcatgacggctgtcgcgctaagctgcgatccgaaactgatcattgccgacgagccgacgacagcgcttgacgtaaccattcaggcgcagatattggatttattgcgggatatgaaaaagcaatttcgcacgtctattttattcattactcatgaccttggcgtggttgctgaaatggctgattatgtgattgtcatgtatgcgggaaaaattgtggaggaaggaccggttgcagagctgttttctgatccgaagcatccgtatacgaaagggctgctcgcggccaagccggttatcggtcaaaaaagggagacgctttacaccattccggggcaggtccccgagcttgcggacctgtccggatcgtcttgttattttgcggagcgatgtgaacacagcacagaaatatgccggagatcgagcccgcattttactgaattcgggaaggggcatcaggcggcgtgctggctttacagagaggagaaagcagatgagtgatgtgttgctggaggtcaaggggctgaaaaaatattacgaggagcatggggggatgagaaagactcataaaaaacccgtaaaagcggtcgacggcgtcagttttacgataggaaagggagaagtgttcggcttagcgggagaatcgggcagcggaaagtcatcaatcggcaagaccattttgaggcttcatgagaaaacagggggagaggtgttttttcaggggcgtgatgtgtttcggatgagccggcgcgagctcaaaactttcagatcggaagcgcagctcatctttcaagatccgttcagttctttaaaccccggcgccggatcggagaagccatcggtgaagcgatgatcgagcatcaattggcggtgaagcggaatgcgcgtgataaagcggcggaggttcttgaagcctgcggactttccgcaacctttatcgaccgatatccgcatgaattttccggagggcagcggcagcggatcgtgattgcaagagcgatggcgctcaagccgcaatttatcattatggatgaacccgtggcggcgttagatgtctccatccaggcgcagatgatcaatttgttcagcagccttcaaaaacagcacgggctgtcatatttgttcatttctcatgatttaagcgtggtggagcacttatgtacgaaggtcgccattatgtatttagggacgattgtggaatacgcgtcaaaggaggagctcttttcacggccgcttcacccttatacgaaagcgctgttatcagccgtgcctgttcctgatcccggagcgaaaagggagcggataattttaaagggtgatataccgagcccctctgatccgccttcaggctgtaaattccgaacgagatgtccggaagccaagaagatatgtgctgagaaaagtccggcgctgtcagaaaaagggcttcatcattttgcggcatgccacttcgtgtaattgagaaaaaaacggttttattgataataaacaggaaaaacctgccgggcagaccggcaggtttttttgatgttattttggtgacggcagtccgagtccttcggcaacgcgtctgccgtattcaggatcagccttgtagaagtggccgatctggcgcagcttaatttcttctttttccacaggtttcatcgcactgacaatattggcgacaaggcgcgcgcgctcttcctcgctcatcaggcggtacaggtcgccggcttgtgtgtaatgatcatgatggttatagcttacactgtcagcgaaacctgatacaggatatgccgcctgtttatcttcaggtgactctttagggcccccgaagctgttaggctcgtaatagacggagcggccgccgttatcatcaaaacgcatttgtccgtcacgctgatagtttttcacttcattgcgggaacggttgatcggcagcgcctgatggttcgcgccgacacggtagcgatgcgcgtcatggtatgcgaacaaccggccttgaagcattttgtcaggtgagacgtcgacgccggggactaatgtgccgggagagaacgtcgcctgttctacttccgcaaagtaattttccggattgcggttcagaaccatgcggccgacttcgatcagcggatagtctttttgagaccacacttttgtgacgtcaaacggatcaaagcgatatgtgtttgcatcttctaacggcatgatttgaacatataatttccatgcggggaaatcgccgttttcaatcgcattgaacaaatcttccgtatggtaatcgggattttcgcccgcgatttttgcggctgtattaacatcaaggtttttcacgccttgctctgttttaaagtgatatttaatccagacgccttcgcctttatcatttgtccatttaaatgtatggcttccgaatccgtgcatatggcgaagagtcgccggaatgccccggtctgacatcagaatggttacctggtgcagggattcgggtgacaaagaccagaaatcccaaacggccgtcggatttttcagatgtgttctcggatctcttttttgtgtatggataaagtcagggaacttgatggcatcgcggatgaagaacacgggtgtattgtttccgacgatatcgtagtttccttcttctgtataaaatttaacggcaaatccgcgcgggtcgcgcactgtgtcactagagcccagttcgcccgcaacggttgagaaacggatgaaaagcggcgtgcgtttaccgacttctgacagaaatgcggctttcgtatattttgtaacgtcatttgtgacttcaaaataaccgtgtgcgcccgcgccttttgcgtgaacgacacgctccggaacgcgttctctgttaaagtgcgccaatttctcaagcagatggacgtcttgtattaaagcaggaccgcgatcgccggccgtcattgagttttggttatctccgacaggagcgccccagctggttgtcaatttatttgaactcatgtgatcacctctttaaatttataagaacataatatcacctatcagtaaaaagtcaatattattttataatgattataaaataattatttttattatcgaaaagaaagttcgggtttgaaagaccacttgactgaggggaataatgggtttaatatgagaaaaaatagaaaccgctgacttggacacaagaggctcttattcttcactggataagggcctttttttattgtcaggcggtaagggaggcggcaattgtatgcttttcaggcagcattttaaacctgtcgatattcacggtcatctgccgtacagccttaatttcggcaaaaacgataagacattttccgattataaccgggagcggtcggaaagaatgaatctcacttgggattttcctgatccgcatgatgttgatggcgatgacggcgaaatcgctttgatgacaagatgggagaaagaattagataagtacggcattgacgtgctgaattttttaacagcagagagcaatgaccggatggcggcgtttattcaagccaatcccgcgaggtttaccggatttgcatatcatcctttggaacaaaaggatgcgtatgaggagctgaaaagagcggttgaagagctcggtctgaaaggatataaactgttcgggccgctgacagacatcgagtttcatgatccgtcgctgaaaaagctgtggacgtatctggctgacaaaagactgcctgtattaattcacttcggacttttagggagagcgggtggcattgtcagccatcgcaacatcaacccgctctccatctatcgcgtcgcgagagagtatgctgatataccgttcatcattccgcatttcggcgccggatattatcaggaactgctgcagctgtgctggagctgcccgaatgtgtatattgacacgtccggctcaaatcagtggatgaggtggatgccgtaccggcttgatttggaaattctgtttcgaaagacatctgaattaatcggtgctgaacggatcatcttcgggacggattcgaacggatttccgagaggatatgtatacagatatcttcaggagcaggtgaggacctgccgggaaatcaatatgcgggaagaagatatagaaaacattttcggcaacaacgcgcggacattattgaaaatcgcccggaaagaaaaggaagtaaatacgtgatacagccgatgcgctctttggcaggtttatgccggaaggcgcatttttaattcatacaaaaaacagttgacaagtcggaataatttgaattaacatgatattcaaatttaaaaacaaacgggttgccgatcggaccgccgaaggctcccatctctgcaagcaatcggagatgggggcctttttgtttttcgatcgcatgcggcagaaagagaggggaagacagatggctgtaaccatcagcatacaagaaaaagtgtttgagcatgaaggccggaaaacgccggtgctgaatgatattgagctgtcaattgcatcgggagaatttttgactgtcatcggaccgagcggatgcggcaaaagcacgcttttaaaattgattgccggtcttgataccgattataaaggctctgtcacaataaacggccgcaatgtgtcgggaccgggcatccggcagggatttatctttcaggagcaccggctgtttccctggctgacggtaaaacaaaacatcgctgccgatctcaatatgaacgacccggccgttcggaaaaaagtggatgatctgattgaggttgtcaggctgcagggagcagagaacgcttatccgcgcgaattatccggcggcatgtcgcagcgggttgccatcgccagagcccttttgcgtgagccggaggtgctgcttttagatgaaccgttcggggcgcttgacgcttttacgagaaaacatttgcaggatgtgctgcttgatatatggcgcgagaaaaaaacgacgatgattctggtcacgcatgatattgatgaatccgtctatttaggcgataagctggcgatcctcagggcaaagcccggccggctgcacagcctgatgccgattcagcttccgcatccgcgcaatcggacgtcagcggattttcaggccgtccggcagaaggtgctttctgaatttgagaaaacggaagacctccggtttgcggacgggtccgggatatagaagggacgaagcgaagtgaaaaaaatcatcattcttttagccgcagcagtcatgatgtcagccggatgcagtgcagacgggacaggggggagcgggaaaacggtgaaagaaatccggatcggcatccagcagagtttaagcccgcttctcattgccaaggaaaaaggctggtttgaagaggccttcaaaaaagacggaataaaagtaaaatgggtcgaattccaaagcggtcctccgcaatttgaaggtcttgccgccgataagcttgatttttcccaggtcggcaattcaccggtcatttccggtcaggcggcaggaattgattttaaagagatcgggctgtctcaggacggattaaaggcaaacggcattctcgtaaacaagggcagcgggattcagagcctgaaagaattgaaaggtaaaaaaatcgccgtagccaaaggcagcagcggctttgattttctctataaagctttagataaagcggggctttccgccgatgacgtcactatcatccagcttcagcctgatgaggcggtttccgcttttgaaaacaaatcagttgacgcatggtccatttgggagccgtatttgtcgattgaaacgctgcagcacggggcggaaatattggcgaacggagaaagcacagatttatattctcccggtttcacgttagtcagaacgggattttccaaagaacacccggatgaggttgtccgttttctgaaagtgttcaataaagcagttacatggcaaaaggaacacaaagatgaagccgtctccttatatgcgaaaatcaaacatcttgatccgaaagtcgtcagaaacgtgcttaacaatactgagcctcttaatgaaccgatcaatgatgatattgtcaaagcccagcaggaaaccgctgattttcaatttcgaacaaaagcgattcataagaaaattcacgtaaaagacgttgtcgacaattcatttattaaaaaagcgcgtgaaacgggggatggcaagtaatgaaagcagaagcaccaacggctgccggcgcaataagccaatcagaaaagaaagctctggcaagatcccggaagtattcataccaatggatgaaagggattgtactcccggctgcggtcatcgcagtatggcagtttatcgcaagtctgggcatcgtctctgcaacggtgctcccgtcacctgtcgtcatcttgcagacgtttcaggaacttcttctttcaggtgagctgtggggtcatttagagatcagtttataccgggcggctgccggatttctgcttggcgcgggcctcggacttgttttcgggctgctggtcggtttctcaaagcggacggaagcgtatctcgatccgtctctgcaaatgctcaggacggttccgcacttggccgtgaccccgctgttcattttgtggttcggatttgatgagacatcaaaaatcctgctgatcgcattgggggctttttttcccgtgtacattaatacgtttctcggaatccgcagcgtggacgcgaagctgtttgacgtcgcgcgggtgctggaatttaattggtatcagcagatggcgaaattaattcttccggcatctctgccgaatatcctgctcggcatcaggctctctctaggcattgcatggctcggtcttgtggtggcggaactgatgggatcgagcgagggcgtcggttatatgattatggatgccagacaattttcacagacaaataaggtgtttgtcggcattatcatttttgcggctgtcggcaagctgacagatgcattggtcagaatgctcgagcggaaactattaaaatggcggaacagttatgaagggtaacctattaaaaaaggagagattcatatggagattctttggtttattccgacgcatggtgacggccggtatttagggacgcaaacgggagggagaacggcggatcatctttattttaagcaagtggcacaggcggcggacagactcgggtatacgggggttctgctgccgacggggagatcatgtgaagacccgtggctgacggctgccgctttagcgggggaaacgagtgacttgaaatttttagtggcggtccggccgggactgatgcagccgtctgtcgccgcgagaatggcgtcgacaatggaccggctgtcagacggccgtttgcttgtaaatgtcgtagcaggcggagatccttatgaactggcgggagacggcatgtttatcagccacgatgaacgttataaggcgactgaggaatttttaaccgtctggcgcggactcatgcggggcgaaacggtgacatatgaaggggaccatatcaaagtggaaaacagcaacctcctgtttccgccaaaacagtctccgcatccgccattatatttcggcggttcatcacaggcgggaattgaggctgcggcgaaacatacagatgtctatttaacatggggagagccgccggagcaggtaaaagaaaagattgaaaccgttaaaaaacaggctgccaaggaaggaaggacgatgcgttttggcatcagacttcacgtgattgtccgggagactgaggaagaggcatgggaagcggctgaacgattaatcagccgcttagacgaagagacaattgcgaaagcgcaggctgcgctccggcgcgctgattcatcgggacaaaaacggatggccgatcttcataacggtgaccgctcgaagcttgagatcagcccgaatctctgggccggcatcggactggtcagaggcggagcgggcacggcgcttgtcggtgatccgcagactgtcgctgatcgaattttagagtatcaggcactcggcattgagtcgtttatcttttcaggctatccgcatctggaagaagcttattatctggctgaactcgtgtttccgcttctgccgtttcagaatgaacggactaaaaagcttgagcgcagactgggtgaagcaatgggaaacgaccattttgcaagaggaaataaagcgacagtctgatgacgtcgcaaggcggatcattgacggcgggcgctttctgcggattcatttccggggaaatgccggcagtgaaggcgggtattcacccgcctttttaagcgcttagcttgcacgatgctcctatggatgatatgatacaaaacgtaattattacgatttgttaggagtgctgaaatggcaaaaaaatcaaaagtgatcaaagagctcaagcggcagaagcttgttgaacaatatgcggacatccgaaaagaattaaaggcaaaaggagactgggaagcgctgagcaaactgccgcgtgattctgctccggccaggcttcataaccgctgtacggtgacggggcggccccgcggatatatgagaaaatttaaattgtccagaatcgcattcagggagctggcccataaaggccggattcccggggtgaaaaaagcgagctggtaatgtaaaaaactccggatctgtcatgaaccggagtttttgccgtgcttatgaaatgtgaaaacataagccaaatgctgaatcatcatcagaatgaaaatcaaaagaatcggaaaaaagggaagatgcggctgaatcagcggataaaacaaaagcagaacggctgcggccggcaatgagaagtaaacggcaatatacgaggaacggcaagctttagccgtcatcattcgttctctttcatcctgttcctcaaattcatcgggcacaagcctgtgctttttgccgtttcgttttttcttttcggcatagatatacaatgcggcacaaacggtaaacagcagaaacggagtgatattcagctcaaatgaaccgctcccctccgtttggaaaaactgagcgatccgcggtgccgcttccataaaggaaataagcgtccagcaggccaatccgtagagtgcaaggtgaaaacacgcttttcttttcaaactcattttttctcctcctccagccagaaaacttcctccatcggcagtgagaaagcccggcagatgttaagcgccaataagagtgaaggcacataatctcctttttcaatcgctgcaatcgtctgtctggtggctccggcttcttttccgagcgtttcctgagaatagccgaatctggctctcagctcttttactttatttttcatcatcagggcgtacctcaagttttcttcttttttatattgtatgagattcttaacaaaatgtaaacctgacttaacatgtggacaaaaaaagaatttttttcgacaaattttttaacattcccttgacgaaaaaaaaatatacatgtaatattagaaacatcaaatcggtactgacaaaaaactttgatgcgggtgtagtttagtggtaaaacctcagccttccaagctgatgtcgtgagttcgattctcatcacccgctccatacatacgttattaacgcagtgtttcgtttctctgataaacgaagtattgcgtttttttatgtgaaaaaagacacgaaggcgtgtctttttatgaaagccaagagacggtatgcgtgcctccgtgaatttgttcaaacattttggttaaagatgatagcagctcatccgccgcgtcggcatgaaatgaaggcgggaaaaagatcagctgcagcattttctttgtgccggttgttacagggcgggtattgagatgtccggtaaggccgccgaaaatgccaccagagtcggaaaaagcaagtacgtgttctttttctccgattgtaatcgaaatcggttcatctatttctgcggcgtcatacgccatgataggcaatgaatatttcaaggagaaaaaaagtatggtatcatgggctgaattcacactttcaatgaatcgttcccgggaaatatcgccgagcataagctccatcggcgttttttgtcctgaaaaggcgggactgagctgttccattatacgcgcccactctttaacaaaaggctgctcatctataccgccgtcagcataatcaaagtaaagagattcttgaaataaacggaggcggcctttcagcatttgcggagcgggcccgacttcgatctgttcatataagacggctgccgctttgatccccggcacccgttcagcaataagtggatctaaactgatgttcaagtgtgttcactccatttcgggatgataaaactctattatacccgtgcgggagcctgatcacaaagaaaggaggctgtgcaaaaaatgaatattcataaactgaaagaggaattaatcgaatacgccaaaagcatcggagttgacaaaatagggtttacgacggctgatacgttcgacagtctgcgggaccggctgattcttcaggaatcactcggctatttatccggttttgaagagccggatattgaaaaacgggttactccgtctttgcttctcccgaaagccaaatcaatcgtcgccatcgcccttgcttatccttccaaaatgaaagatgcgccgaggagcacgagagacgggcggcgcggcattttttgcagagcttcctgggggaaggattatcatgatgtgctgcgggaaaagcttgatctgctggaaaattttctccaaagcaaacatgaggatatccgcacaaagtcaatggtggatacaggagaattgtccgacagggccgtggctgaacgggcgggaatcggcttcagcgccaaaaactgcatgatcaccacgcctgaatacggttcttacgtctatctggctgaaatgatcaccaatctgccctttgaaccggatgtgccgattgaagatatgtgcggtacgtgcacaaaatgtctagacgcttgtccgaccggcgcactcgtcaatcccggacagcttaacgcccagcgctgtatttcgttcctgacccagacaaagggatttttgccggatgagttccgcacgaaaatcggaaaccgtctgtatggctgtgacacgtgccagacggtctgtccgattaataaggggaaagattttcatcttcatccgcagatggagcctgatccggaaatcgcaaagccgctgttaaagccgcttttgaccataagcaaccgcgaattcaaagaaaaattcggacatgtatcgggatcatggcgcggcaagaagccgatacagcggaatgcgattttagctttggctcattttaaagatgcctcgtctcttccggaattaacggtcttgatgcaccaagatccgcgccccgtcatcaggggtacggccgcctgggccatcgggaaaatcggtgatcctgattatgcggaggaattagaaaaagcgcttcaaaaggagcaggatgaggacgccatacgggaaattgaaaagggactggagctgttatcggtttctgagaagactaaaaccggccggtcctgacatatgtatagagaaaaagcacttggccggagttcaagtgttttttctttataaaatcgtatggggtggagcgcttgaagcatattattgaagatttagcggaggcccggcttcattatttaatcaacggaaccgagatgaggcagaatgggcaggccggcgatcttgaggtcctgacgagaaaaaaagagctgtttgaaaaacggaaagttgatatcgtgaaggcgaaggcaaaagccgtcattgtcaaaagcagtcttgaggacgacggcacgttatgtgtcatgtacacgattcatttcgaatatttgtgcaaggagcatgacggacacctttacttagaagagcagattgaggaacggattgcatttctctatgatgagcttttgattaaagaccgggaagtaaagaaaaaaccggctggattttctgacggaaacagcgtaattgaatatgagcggagtgaacgggaagatttcgggcgggcgtttcaatacgaccgtctggctgccgtgcagtacgcggagaagttttggaataaacgaaatcccgcttataaaaatttcagcgataattgcaccaattttatttcccaatgtttacatgccggaaaagcaccgatgcgggggcatccgaacagaggctcaggctggtggatgaaggcaagctcgtggagctacagctggacggtcgcgcattcgatgaagatgtatctggcccaatccaaggcagggctccgcgcattgcaagtatcaagagctgaagaactgatgcccggagatatcatttgctatgattttgaaggagacggccgttttaatcatacggcgatcgtggtcgcaaaagataaaagcaatatgccgctcgtcaatgcccaaacgtatgacagcagaatgagatattggtcatatgaggattcaacggcgtatactccttccatcagatatgcgttttttcatattacggatgatacgacaaaagagtaattaatgatataatggtgggcggaataaaaaacagaggtgaacatcgtggcattacatgtcgttttatatcaacccgaaatcccggccaatacgggaaatattgcacgtacttgtgcggcaacagacacaacgcttcatttgatccgcccgctcggattctcaaccgatgataaaatgctgaagcgcgccggactcgattattgggagttcgtcaacgtcgtatatcatgattcattggaagaattatttgaggcatatgagaacggaaagtttttcttcattacaaaattcggccaaaagccgcacacatcatttgattactcaaatacggaggaagactttttcttcgtattcggcagagaaacgagcggacttccgaaagaattgatcgaaaacaatatggaccgctgcctgcgtctgccgatgaccgagcatgtgagatcattaaacctgtccaacacggccgcgattcttgtatatgaagcgctgcgccagcaaaattacagagatttgacgtgagaaaaaacgcccgcatccgggcgtttttttattgaataaaaagacgggcagcagcggttcacggcatttttatattttcagccttaacaacgtaacagtgttatgttacaatacattcatcgaaggagctggattcatggaggaacaactgatttctaaaaaagatttgctggaagaaacatcaatttcatacgggcagctgtaccggtggaaacggaaaaatttaattcctgaagaatggtttatccgaaaatcgacgtttacaggccaggaaacattttttccgagggcggaaatattaaaacgcatctcaaaaatacagaaaatgaaagaaaatctgtctctggatgaaatgagagaaatgctgtctccgcaaatgactgatgtcaatataacgtctgcggaactgcttcaaaagggactgatttcaaaagccgcgctgcaagtttatggcgaagacggcgtgacattcacgtcccgcgcgctgctgtctttatatgtgcttgaagggcttttgcaatcgggcaatatcagccttgaggaaggaaaattggcagcaggggtgctgaaaacgtatgaggcttccgagctgaaagcgaatacggagcttgtcatgctccgaaagcttggcgtaacgacgtgcttcatcgcagacgcggaacatattttgtttgaaccgactgtcaaagtggttgaacgggtggcgcttgctgcggcatcggaagaattaaaaacgaaatggatgcaggaggaccatcaatggaagtaacagataaattaatcattaacggttcgggaagttcaaaaggaggccgttttcatacagtggagatcaacggaagcggcacggtgtcaggtgatgtggagtgcacgagccttttgtttaacggcagcggaaaaacagacggacatgtcaagacgcaaacgctgacgatcagcggttcggggaaaatttccggcagcgccgaagctgaatccatccgtatcaacggaacgggtgtcattaaaggtgatgtcaaaacggagcggctgaacgtcgcgggattttcatctttcggcggcggtgtgaaagctgatgatattttcatatccgggaaagccgggattgaaggcgattgcgagacagagacgttccgttcggaaggcaaatgcaagatcggcggcctgctgaatgctgatgaagtcagtattaagctggcggcgggagagagccgggtgaaagaaattggctgccgccatttgaaagtgatgagcagaaagagcgtgcttacgcgttttaagctgatgccggccccggtgctgacagcagagctgattgaaggtgacatcattgaattggcggacacgaacgcgaagacagtccgcggaaatcatgtgcggatcggcgcaggctgcaccattgggacggtggaatacagcggcgattttgcatgtgatcctaccgctttggttaacaaagtcatgaaacgataggaggagctgcgatggaaacgacaaaaaaattgagtcatttaaaaatgtacggagccggacacgcctccggcggttcctaccaaaatgtaagcattaaaggggaaggaactgtcggcgaaggacttcaaagcgaatgctgccggatattcggcacgggactttttctcggagatgccgagatcaacaggctgaaaattttcggagagcatgaagttgcaggagatttatcagcacattcagcaaatgtgatcggcacattgaaagtcggcggctccatgcgtttcgccagaatgaggctgaaaggacttgctgaaattggcggcggggccgcgggagagcagtgtcacataaaaggcagtctcaccgtcggcggcgattgcgagacggagctgcttcatgtaacaggatgtatcaatgtggcgggattgttaaacgcaggggacgtaaacatccatttgcgttatgaccgaagccgtgtgaaagaaatcggcggcacatcgatcaccgtcagacggaaacccggttttcttaaacggaaagccggcatgctttctgctgaattgatcgaaggagacgcaatttacctcgaatacacggaagcggacattgtcagagggaagcgtgtggaaatcggcccggggtgcaaaatcggaaaaatcgagtatcaaacaagctgcaagtctcatgaaaaatcaactgtccaagaacatattcaaatatgaaacattgttatgttgtacaggaaagggtgctctccataaagagcacccttttgccgttatttgttttcaggtttgctgtcgtaacccgccgtaaaaatggatactaaaaaagtgagaatgaccccaagtaaaatgatcgttttcatcatgtctcctcctctttgcttttccatttgatgtccgagtctggatgaaactgtatttatttcattatgaacggtgcaccggacccttgtcaatgacggccttatcacgtctttatttttaagaaacgaaaagcatgtattatcacgtcaccgcatagattgtaacaaagtaccttatttctagtgcattaaccatgatagaggaggttcttatggatatattaaagaaaattgaaaagtacagagaggaagagcagcgtctcaaatgggaagggacgttcgctgattatttggagatcataaaagaaaatccattggtcgcgcagtctgctcattctcgcgtttttaatatgataaaagacagcggaatcgaagagggtgacgggaaaaagacatacagctttttctcgagggagctgttcggccttgaggaatctctggaacggctcgtggaggaatactttcacccggctgccaagcggctcgatgtaagaaaaaggattttactattgatgggacccgtcagcggcggaaagtcaactcttgtcaccatgctgaaaaaagggcttgaagcctactcattgacagacaacggcgctgtttacgccattaaaggctgcccgatgcatgaagatcctctccatctcattccccatcatctgcgcgacgacttctacagagaatacggcatcagaattgagggcagcctttctccgcttaatgtcatgcggcttgaagaagaatacggcggcagaattgaggatgtaaaggttgaacgtatattcttctcggaggataaacgtaccggaatcggtaccttcagcccgtctgatccgaaatcacaggatatcgccgacttgacggggagcattgatttttcgacgattgccgaatacggctcggaatcagatccgcgcgcttatcggtttgacggtgaattaaataaagcgaaccgcggaatgatggagtttcaggaaatgctgaaatgcgatgaaaaatttctgtggcaccttctgtcactcacgcaggaagggaatttcaaagccggacggtttgcgctcatctccgccgacgaattgattgttgcgcatacgaacgaaacggagtaccgctcgtttattgccaataagaaaaatgaagcccttcactccaggatcatcgtgatgcctgttccttataatttaaaggtgtcagaggaagaacggatttatgaaaaaatgatttctgaaagtgatgtttctgacgtacacatcgccccccatacattaaaagtggccgcgatgttttctattttgacccggctgaaggaaccgaaccgctctgatattgatctcgtcaaaaaaatgagactttatgacggagaaagcgttgaaggttacaattccgttgatctggaggatatgaagaaggaattccatgatgaaggaatgagcggaattgacccgcgctatgtcatcaaccgcatttcctcaacgattatcagaaaaaatatggaatccatcaattcgcttgacgtgctgcgttccttaaaagaaggactcgaccagcatccgtccatctccgccgaggacaaagagcggtatatgaattttatttccgccgccaggaaagagtacgatgacatcgccaaaaaggaagtgcagaaggcgttcgtctattcatatgaagaatccgcgaaaactcttatggacaattatttagataatgtggaagcgtactgcaataaaaataagcttcgcgatccgctgacgggtgaagaaatgaatcctgacgaaaaactgatgagatccattgaagagcagatcggcatttcagaaaacgcgaaaaaagcgttccgcgaagaaatcttaatccgcatatccgcctatgcaagaaaaggaaaacgctttgactataattcgcacgaaagactccgcgaagcgattcagaaaaagctgttcgcagacttaaaagatgtagtgaaaattacgacctccaccaaaacgccggatgaacagcagcttaaaaaggtcaatgaggtagtggcaaggttaatagatgaacacggctataattcgacaagcgctaatgaactgctgaagtatgtcggaagcttgttaaaccgctgatatttgatttcatcgagaggcccgtctgtaaaaggacgggttcttttgtctgtttttcgcaattgtttgtcaattggagagtccggccggcataagataaaaataaatcttttcgccggacttgtttcataaacaggaccaagccggaatacacatgtaaaacgaccataacggttaaggaggggaattcatgtcccgtaatgacagcggaaattttttgatttcagaggaagactggtccctccatcgcaaaggctttgacgaccagcagcgccaccaaaagaaagtgcaggaagcgataaaaaacaaccttccggatcttgtcactgaggaaagcattattatgtccaacggaaaagatgtcgtgaaaatcccgattcgttcgcttgatgaatataaaatccgttataactatgataaaaataaacatgtcggccaaggcgacggcgacagcgaagtcggcgatgtcgtcgcaagagacggcgcagataaaaagcagggcgccggaaaaggccagggagcaggcgatcaggcaggcgaggattattatgaagcggaagtttcattgatggatctggaagaagcgctgtttcaggaattagaactgccgaatctgcagcaaaaggaaagggacaatatcgtccataccgatatcgagttcaatgatatccggaaaaccgggctgacagggaatatcgataagaaaaggacgatgctgtcggcctataaacgaaacgctatgacaggcaagccgtcgttttaccctatttatccggaagatctgaaatacaaaacatggaatgatgtgacgaagccggaatcgaaagctgtcgttttagccatgatggatacaagcggttcgatgggcgtatgggaaaagtatatggcgaggagcttctttttttggatgacacgatttttacggacaaagtatgaaacggttgatatcgaatttatcgcccaccatacggaagcgaaggttgtgtcggaagaagattttttctcgaaaggcgagagcgggggcaccatctgttcctccgtttaccggaagtctcttgaattaattgatgaaaaatatgaccccgcccgctacaacatctatccgtttcatttttcagacggagataatctgacttcggataacgcccggtgcgtaaagctcgtcaatgacatcatgaaaaaatcgaatctgttctgttacggtgaggtcaatcaatataacaggcattccacccttatgtccgcctataaaaatgtcaaagatgataaatttaaatactacatcctgaaacagaaatcggacgtatttcaagcgctgaaaagcttttttaaaaatgaggaagccgatgtaagcaaagcatcgtattaaatataaagccgagtgaagaatcgtgcggcgcggttctttacccggcttttttaaattaaaaataaagagaaaaaccggcataaaaaaaatccttaaaaaatgaaacttttctctttacaaaccttctttcatttattaatattttatcttgtgaactattattaagggaatgaggtgaaaatacggtgattgaatcagagctcgctttgctcagttttgaacaactgtttgatacttccagatcgatttacaaaaagcagaaaatgattctggagacagtgcttgaaccttttgatattacagtgctgcagtatctgctgatgttcaaaatacataagagcaaaagcacgcagctttcaaggctggctttgtcgcttgatctgaaaccggcgtctgtcacgagaatgaccgatattctgtataagcgccgcctaatggttcggagcgactatcacgacgaccggcgtgttgttatgattcagttaaccgaagagggggaagaacttctaaagaaagctgctgttcaatatgccgaaaaagcggcggtcttataccggcagctcaataccgctgaactgcagtacctgcgcaagcttgcggaaagtttaacgaagcttgcaaacggctgtgcagtgaaaaacggaaaataaaaaaatccccacatatttttatcatcattccacaaaatgatagaggaagaaacgaaaggagaaaacaaaatgaacagaggacgtttaattctgaccaacattatcggtttgattgttgttcttgcaattataggcggaggtgcttactactattatcaaagcacacactatgtaaaaaccgatgaagcgaaagttgccggcgacatggctgctatcacagctcctgctgcgggtaaagtaactgactggaaccttgatgaggggaaagaagtaagcaaaaacgacgttgttgcaaaaattaaaggacagcaaaatgctgacgtaaaagccatcatggatggaacaatcgtgaaaaacgaagtgaaaaacggccaaatggtgcaagccggtacgacaattgcccaggaaattgacatgaaacacctttacatcactgcaaacattaaagaaacagacattagagacattgaagtaggaaacaaagtagacgtaattgttgacggcgatcctaatacaacatttgacggaacagtagaagaaatcggttatgcgacaaattcaacatttgatatgctgccttcttcaaactcaagcggcaactacactaaagtaacgcaaaaagttcctgttaaaatttcactcagcaacccatctgacaaggtgcttcctggtatgaacgcatctgtaaaaatctctgaataatacagatcagtcatcaaaccatgaagggaggttgtcttaggtggctaaatcagataatcaagtaaaaagtcctaaaacattgcttattgtgcttatggccggattattcctggcgatcttgaaccaaacgcttcttaacgtggcgatgccgcacttaatgaccgagttcggtgtgagtgcgacgacgattcagtggcttacgaccggatacatgctggtcaacggtgttttgattccgttatctgcgttcttaattacccggttcggacagagaagcctctttctcgtagccatgttctgttttacagcgggaacgttagtctgcggaatcgcgcctaacttctcaaccatgctgatcggccggttaattcaggcggtcggcggcggtatcctgcagccgctggtcatgacaaccattctgcttatcttcccgcctgaaagcagggggaaaggaatggggattttcggtcttgcgatgatgtttgctccggcggtcggaccgactctatccggctggatcatcgagcattacacatggcgcattatgttctacggccttgttccgatcggggcaatcgttattatcatagcgtttttcctctttaagaacttggtggaaccgcaaaaaatcaaactcgacagcttgggtgcgattctatctattgtcggattcgcctcattgctttacggagtcagtgaagcgggcagcgacggctggggagatccgatcgtgctgtctaccgtcattgtcggtgtcatcgcgattgccgcgtttgtcattcagcaattgcgctctgaaaaaccgatgctcgacttccgggtatttaaatatgatattttctcactttccagtgtcattaatatcattattaccgttgcgctttacacaggaatgttcctgcttccgatttacctgcagaacttagtcggctttacggcgctgcaatcgggtctcttgctattgccgggcgcgattgtcatgctgatcatgtcgccgatttccggtattctgtttgacaaaatcggtccgagaccgcttgcgattatcgggctggtcatcacggtcgcaacgacattccagtacacaaaattgacaattgacacaccttacacgcacattatgcttgtctatgccatccgcgcattcggtatgtcactgttaatgatgcctgttatgacagccggaatgaaccagcttccggcacggttgaacagccacggcacggcgatgagcaacacgctccgccagatcagcggatcaatcggaacaagtttgatcacaacgatttatacgaaccgtacgacaatgcattattcgcagattgcggataaaacaagcacggctgatccaagcttcatgcagtcgttccaaagcgcggtttctaatttaatggtcaacatgaacatgtcgcttgatgcggcgaaacaaaccgtttattcatatctctacaaaacagcttcacttaattccaacgttatggggattaatgacgcgtttatgtgggcgacgatctttgcggttatcggcgtagtcctgagcctgttcttgcgtgacgtacggaaagacaaacagcgggcgaagaaaaaagaggagctgtcattgcttccggcccctaaagaagtgaaggaatcttaatcatctgaatgggaggtttcctgaatgaaaatttacgtagtgtacgatagtgaaggcgaacacacaaaacaccttgctgaagccattgccgaaggagcacgagaaaacgctgaggctgaagtcctgatcgaccatgtcgatcaagcagacatccgcaagctgaaagacatggatgccattatctggggatgcccgggacactttggcaccatcagttcaggcttaaaagcgtggatcgacagactcggctatctgtgggctgaaggcgagctgattgataaagtcggcgctgtattctgtacgacggcgacaacacacggcggattagaaatgacaatgcacaatctgatcactcctatgtttcaccaaggcatgattgttgtcggtcttcccggcaacgttcctgaaaacgcgctgtacggctcttactacggcgcaggcgtcacatgcccggttgacagcgatgtgctgatgacggaagaaggccttcaattaggccgtgcgcttggcagacgtgtcagccaggtcactggtaatctaactgccggacgacagtaaggagagggttatatggccattattatagcggttattgctgctgtcattgtgattgcacttcttatcacattcaatgtccgcagcacttctgcaggacaggatgtcaaagaagaaaagagagaagcgatcggcactacagccgaacagccggaaaagcatgatccggccgaggagcgctcagccgagcatgctcccgtcgttgtaaaatctgaatctccccgtgagaaaaagaatacaatgggcgatgatgtgtaccgtcaggcgcttcagaagtttaagacttctgagacggatcaggaaccaaacgatcctgatagcggcggcaaaatgcaggatagcagctatcgtgatgcgctgctctccttaaaaaacaaaaagaagtaattgaaaaggcaaatccgcgtaagagcggatttgtcttttttttattgaagatattgtaatacatgatgatctagtgtactatgttactcatacacttgatccgaatggagagagaaagaatgacatcgtttttaggtttgctgaaaaaagatgcgaaagtttcatggatttggctcgcggtgtggctttgcggcatgatttgctgggcgtttgcagcccacatcatcgctgcccgtcagaaagaaccgctcgtcattttcggcttttttacggcaatggggttttttcaatttcttgtagcgccgctttttatgtactatcaccttcataaagaaggaaaaaatcagctgtggctttacaatccgaatgggggattttatctgctggcttccaaactgacggcctcactgctgtatcagttgatcgggcagctggcgctgaccggttacggcatttggatgtaccggatgctttctgcaaaaggagtgctggaacacaccattcccctggccggcacattaaccgggctgaatgcttacctgctgatcagttcagcgtacttatctgtgatcgtggccgtattttggactgtttttcactcattaaaacattttcccgtcctccgttgggtgatctgcatcgtgcttgcgtttgtctggacctatattgacgataaaatcattacgcctttcacttcatctcaacatgatttatggccggtaaaagtgtatgcgaattttcattttcattatacaaaattgaccggatggacgatggagctgaaagccgtccacatttcgcttttcagcttcctggcagtgatcgtgcttgcagcgctctgtctcgcgctggcctctatgctgctgaatcgaaaggttgaggtgtaatgatggagaatgaatttcggtcatccaagccgatttatctgcagattgccgatcgtatatattaccggctgatcagaagtgagctttcaccgggggacaaactgccgtccgtaagggagatggccgtacagatgaaagtgaatccgaacacgatacaaagaacgtacagtgaaatggaaaggctggggatcgtggagacgagaagaggacagggaacctttatagcggaaagatccgatctgaaagcagagctgaaagacaggctgacaaaagacgttttcaaacgctttattcaggaaatggcggagctggggttatctcctgaggaaatgctcgacgggatcaaacaatatgcggaggaagcaaacgatgaatcttgattttgaacgcgtaacaaaaaaatacggccgcaggatcgcggtcagcgatgtatcattttcattgtctccgggtaaaatctacggaattttagggccgaacggaagcggtaaatcaacaacgcttaaaatgcttgccgggcttgcgttcccgacatcgggcgccgtccggatgggagactgcgcagtaagcaggaacatgctgtttcgtacggcttatttaaccgaacatgatatgttttccgcccggacgactgtcggtgatatgctcacattttatcattcgcaattcccggattttcagctggaaaaagcacataacctattagcggaaatgaatctttcagcggagcagaagataaaagagctgtccaaaggcagccggggcaggctgaaaatcgttttggccctgtcgagaaaagcatcggtcattctgctggatgagccgttttcaggtcttgatccggcggtcagggagtcgattgtcaacagtctcgtatcttatattgattttgacagccagatcgttgtcatcgccacgcatgagatcggcgagattgagacgctgttagacgaagtgatggttttcataaaagggaaaatcgctgaacggcgcgaggtcgaagaaattcgggaacaggaaggaatgtccgtgctgcaatggtatagaagcgtcatgcaggcgcacgaaatagaagggggattctaattggaaacggtattagaactgcaacaggtaaagaaaacgataaaaggacgaacgattattcatgatctgagcttctccgtccgggcgggcgaagtgtttggatttttagggccgaacggagcggggaaaaccactacgatcagaatgatggtcggattaatgaaactgtctcagggagacatcgtaatctgcggggaatccattacgaaaaactattcaaaagcggtcaggcacgtcggagccatcgtggaaaacccggagctgtacaaattcttgagcggctataaaaatttacagcagtacgcaaggatggtaaaaggcgttacgaaagaaaaaatagatgaggtcatcgagctcgtcgggttgcaggacagaatacatgacaaagtaaaaacctactctctcgggatgagacagcgtctcggcctcgcccaaagcctgctgcataatcctaaggtgctgattctggatgagccgacaaacggcctcgatcctgccggcatcagagaaatcagggaccatctgaaaaagctgacacgtgaaaaaggaatggctgtcatcgtctcaagccatcttctgtcagaaatggagctaatgtgcgatcgaatcggcattctgcaaaaaggagagcttgtcgatattcaaaaagtaagggatgaaggaaaagaggataaagatacatactacttccatattgaacaaagagaagaggctcttgccgttttgagtcagtttgactgtgtgaagaagacaaacggcattgagatccagctgtccaaacaggaagtgcctgatgtgatatcactgctcgtccgtgaaaacatccgcttatatgaagtgaaaatcatgacaaaatctttggaagaccgtttcttggagattaccggcgggacgaaagaggaggttcaatatgtttaagctgatctataatgaatggataaaaattttcagccgcgtcgggacgtgggctatgattgtgattttaggcgtttcgatgatcggttttgcgcttttgtcaaaccatttcacctcgagtgaagccaatccgaattggaaacaggagctccaggccgaaaacaaagaaatgaaacagcagatgaaggaaaccggaaatcagacgctcattgataacctgaaacagaatgtcgcgataaatcaataccgtatggatcataacatccccgaggatacagggtacacagtgtggtcatacgtagctgattcttcgatgatgactgttttgaccgggctgtttacgattatcattgccgcaggcatcgtggcgaatgagttcaactgggggacgatcaagctgctggccatccgtccgctcagccgttttcagattttgctatctaaatatatgacggtgctgctgttcggactgctgatgcttgtgattttatttgccggctccgctctgttgggattggtcttttttggtacaggcggagatactgcggctgatgttcatctcgtatacaaagacggccatgtttttgagcaaaatatcatcgctttcctcgctaaaacatatgtctatgaatctgtctccgcttttatgcttgcgacgatggcgtttatgctgtctgcggtattccggaacagctcattagcggtcggattttctatttttctattggttatggggaacacggcgacggtatttcttgctgcgaaatttgaatggaccaaatatattttatttgcgaacacagatttgtcgcaatatatgaacgggactcctttagtagaggggatgacgatgacattttctgttgtgatgcttgtgatttacttcgttatttttctggcgctcgcattcggcgtcttcttaaaacgggatattgccacctgatataaaaaagctgttttgcctttgcaaaacagcttttcgttttagatgaaaaaaacctgccggcgtacaccggcaggttttttaaaacaatttatgcttttgttacgttagcagcttgtggtccgcggtttccttcaacgatttcgaaagaaacagattggccttcttctaaagttttgaagccttcgccttgaatagcagagaagtgaacgaatacatcgtcttgaccttctacttcgatgaatccgaatcctttttcagagttgaaccattttactttaccttctaacatgaaatttcctcctaaagcgacataacgcttaaattcactattcttgctctaaaacaaacttccaagacgaaaactcttacaaaactttcttcttaaagatagttcgaacaaaaataattacctttactctaccagcaatccgaagaaaaaacaactgctaaatgtaacttttttcgaaataacatgttttaagaggaaaatgctctgatacggaaatctgatttgagaccagaacggcccattttcagctgataaaaaccgcattgcagcctcttaaggaagcaattgacaaccctttttttaatcggtattgtatgtaatcatgagcccgaataccatggtgcagcttctgtacataaaaatagatagggagtaggtcaacttgaacctgcggcttataaacagtctgtttcttttcattttgatcatgtcacttacttcatgccattatcctgatgggaaccggaccattactatcggaatcaatgaatctgatcaatcgatctgggagtttgtcgcgaaaaaagccggtgaggaaggattgcggctttctttggtaacgttttcggattatgccgaggccgatttggcacttgccggcggggatctcgacgccaatgcgtttcaatccgttactaattttaaatctttgcagcctcatgtgaaaaagaagctggctcctttaggaacgacatatgcggcatcgctgggggtgtattccaagcagcataaacggctgaaggatataccggacggagcggtcattgccgtgcctgatgaagcggcggccttcggcagggcgctttttctcatgcaggaggccggactgattacattgaaaaagggattcaccggtacgggttcaacggatatgatcaaggacaacccgaagcatctgaccttaaaaacggaaacaaaaaagaacgcctatcaggcggcggaacatgctgacgcagcagttctcagtcaaagcgaggcgaaaaaagcaggatttcatgcggagaaggacgcgctgatccgatcggcgcaaatgaaggaagcgtatattcatctgatcgccgtcagagctgaggataaagatgatgaacggctgcaaaaactcctgtctttgtatcaatcagacgataccgcggcgttgattgaaaaagaatatgagggcagcctgattcccgttttcctgaggggcggctttctcactgaaaagaaagaatgatttcctcttcgggcgatcattcttttttttcagtgctgcacacttgattgcgccctgatgttttcgctttgtacagcatccggtccgcgatcaggggcaatgtctgaggatccggtgtatttgtcggataatgcgcgatgccgagggaaacggtcacgggaattgtatctccgctcgtcagcagaatcgggttcgcgtcaatcgtgtgcctgatttcctctgcgaggtgaagcccttttgtataggtgcaattgggcataagcacggcaaattcttccccgccgatgcgggctgacgtatgagaactgctgagtaagaacctcaggcgcgcgcccagttccttcagcacttggtccccttcataatggccgtattgatcattgatctgcttaaagtgatcaatatccaaataaataagcgcgagctgagacgagggggattgagacgcccgatcgtacagaacgcgcgagacgtcctcgaattttctcttattaaaaatccccgtcagaaaatcataattcgcttgaaacttgtattgcttgaacaaaacgcgggcatcggcttcgtgtttgatgatatacagtgacagcattccgcccaagacggaaatgagccaataataaacgagggccccggcaggctgttcaggcataagaaacagcagcgtcagggtgaaaataacatttgaaaaaagcagcataacgaacgcctttttgtgatccggcttttttcctctgaggacggccgcagaaagtatcgcaataaccccgactgcggcgatggaaaaaatggcgctggcattgaaattgatcaggatacggcctgcgacgataatcgcaaaggcggctgccgtagacacccagcctccgtaaagagcggcgatgataatggggatatttctgagatcaatgatggaatcggagtaagaaaagccgaaaacaatcagaaaaacccctaaaagcccgcagaccgttcccttcagtaattgaaacatcggacggtcttctttatacgaaagcgactctttaaaaagaagggtgaacagataattaaatgtgattaaaatcgttaaattaagaaacagttccttcagcataacaatcacccttatataagttactagagaaagggtggaaagaaaagagaaaaatcaataaaaatacatatattgtcaatccttacttgaccgatcggaattgatataatatagtgttaaaggataatgagcaagggagtgtttacctgttttggagaatttatttgtagtcttacatgtttttattatgcttttgcttatagcaggtctgtttgtcatgcaaaaaaaacacgtttccttttctaaacgtgtctttaccgcgctcggactaggcattgtattcggttttgcactgcaattgatttacgggccggcatcacatatcgtgacacaaacggccgattggtttaatatcgccggcggcggttatgtcaaattgcttcagatgatcgtcatgccgctagtctttatttctattctcggcgcatttacgaagctgaaactgacccataacatcgggaaaatcagcggactgatcatcggaattttgatcgccacgacagcaattgccgcggcagtcggaattgtttcggcgctttcttttgatctgaaagccgtccatatcgaccagggaagcaccgagttatcaagaggccaggagctgcagcaaaaatctgaggatatgacggccaaaacgctgcctcagcaaatcgttgagcttctgccgggaaatccgtttcttgatttcacgggagccagaccgacttccaccatcggagtcgttattttcgccgctttcctcggcatcgcttttctgggcgtgaaacggaagcagccggagcacgctgcgacgttcagcggaattgtcgatgcggtatacgcgattattatgcgcgtcgtgacgttaattttaagattgacgccttacggggtattggcgattatgacaaagacgatcgcgacaagcgacatcgacagcattgcgaaactggggatgtttgtgatcgcttcatacgccgcgcttatcgtcatgtttatcattcacctgctgctgattacgttcagcggtttaaatccgatcacatacgtgaaaaaagcatttcctgtcatggtgtttgcgtttacgtcccgttcaagcgcaggggctttgccgcttaatattaaaacgcaaaaaagtatgggcgtccctgaaggaattgcgaacttcgccggttcattcggtttatcgatcggtcaaaacggctgtgccggcatttacccggcgatgctcgcgatgatgattgcgccgacagtagggcaaaacccgtttgaaccgggatttatcatctccgtcatcgccatcgtggcaatcagttcattcggtgtagcaggcgtggggggcggcgcgacatttgcggctctgctcgtcctatccgctttgaacatgcctgtcgcgcttgccgggctgctcatttcaattgagccgttaattgacatggggcgtaccgccttaaatgtcagcggcagtatgaccgcagggctgttaacaagtaaaatgacgaaggaaaccgataccgcggtttacaatgattcctcaatcgtcattgaagctgaagaagcttaataaaaaagcagatagcgctaaaacgaaaaatccttcatcgttgaactaatgaaggattttttcgtttctaatgatttccgggttcaatttcttccagcatattcatcacggtgctgtcatttaaaacatttaccgcgctttcttcgaagtgaatcggctcggtatagtgaggcttcggcgaagtttttttactgcggtctgcctgtccgtccgtatgggatgagccggagtggttgcgggaagtctgctcatgctgctgtccgccggattccccgccgaaagcctgtttgatcagctcggcaggctgcatggagccggtttgtgaatgccgtgctttgtccgtgtgctgctgtccgccggattccccgccgaaagcctgtttgatcagctcagcaggctgcatggagccggtttgtgaatgccgtgctttgtccgtgtgctgctgtccgccggattccccgctgaaagcctgttgaatcaggtcagcaggctgcatggagtgtgtaccatctttatgctgcattcggcctgaaaccattccggagattttccggcggatttcgggtgataaagctgcgatcagaatcgatgatccgatcagcagcgctgtcgggctgatgccgcttttttgtctgaacaagttaaatccctcctcattcaattgattacgcttacctttccctttccttctgatatttatccaaaccgctcagaatgcaaacggcgtgcataaatcccgccgaatagaaaaacctatacgtaaagtgagaaaggaggaattcacatgataaaaaaacaagcagttatttctgcccttcttctgccgatgctgattaccgcagggtgcagtatggggaaccagggagaaggaaaacgaaatgacaaccgcacccagaatgtaaattaccgcaacacgcctaacgacggtgcgacaaatatgaatacagtgaaccgtcataaccaaaacaccgatcacaatgacaaccgtaacctgagagtggctgataaagccgccgacaaggtgactgatttaaaagaagttaaaaatgcgactgtgatcgttgccggaaacagcgcttatgtagccgttgttctgacaaacggacaaaaaggcgccatcgccaaccatttgaaaaataagattaccgataaggtgaaatcagccgataaacatgtccggactgtatatgtatcagcgaacccggacttcgttgaacgtatgcaaggctacggaaaacgaatccaaaacggccatccggtatccggactgtttgatgaattcggccaaatggtgcagcgtgtattcccaaaccccaataaataaatgaatggaaaagccgcatttgctgcggcttttttattttatctgccgtcacgacccagcgctcctgagcataaagtaaagaatgagatgaaaattaaaggatcggggaggggagcttgtttgcgtgacggcatggggaaacgggcggcattcactctgatcctgtgcggagtccttgtcatattggctgtcagttcagccgtttcagtaagtatgatgtacgtcctgtcaggccaaaacagccgctctgttccgacgaaggaacaagtgactgaacacatgaataaagaaatttacaaacatacagcgatttactatacggcggatgaaaagccgctcttggatctgaccaagcttacgctggaccacgcaaagcgtatcaaccaaatcattgtcggctataaaggagcggcgcctcttgaactcattttcttttcggatgaagctgaaatggagcaatactcaggattgaaaaatgtagtcggtttttattcagagcaggagcagatgatggggcttttgcctgaagagaaaaaacagcttttgaaaaaagatgagctggccgttttcatgtataagcaattgattatacatgaatatacacactacgcgtttcatcaaaaaacgcggcaattggggacggatacgtctgtatttccgctttggtttcatgaggggctgagcgagtgggttgcgcattatgatgtggtcattgatccgattgcattttccgtcgtgccgtttgatcaattaacgaccgaccgaaaatggcagaaatcgcgtatggaatatgaaacggatgtctatttgcaaagtttctatatgataaaggatttaaccgaaacattcggagaaggcattatcttaaccattatcaataaaaccgccgaaacacaggattttgaaaaaggctttgaagcggctacgaaagaaagtctgaaacaatttgaacatgatttcacaaaagcatatgaaaaaaagaaaacggcattggagagtcaggtttccaacgccgtttttttcattaatggaggttttgctgctgctgtcccatttgtcctttaatcggaggcatttgcggctgtccctgcgccggcgcaaatgaattcagcatggtctgcatatcttgtgcattgagctgaggaacctgataataaccgtgtttgttttggtataaaaagatttcatacgccatttcgacatattgctgaatttgggcggagagcactcttcttgtgacgggattggtcatttcaagcgagctcatcgtcaagagagaagcttgagctttaatcaggccgagcatatggccgcttattccgagatctttgacatcatttaatgattgattcggttttttcggctgagtcggttttataccgtagacggcctggttctgttcctccatcatatatgtcgacgtttcctgagaaggtttttggccggtcttaaagcattctgccgtcagattatagagtccgagaatgaattgatactggcggtcaagaatgtcggccagctgctgatcctgaataaactgtctgagcatcataaattgatccaaaacgccgactgttccggccagcacttcatgcatatcgaaaagctcatgtcctccgtgattcacttgcggtgaacccggaatcccctgatttactggcggctgctgctgattctgctgctgttccactggttgttttcctccttcatgtcaaatcacatttaagatgtgaaaaaagccgatccgttatacatcaagacatatttcgttacatggggattatttactattttgcgccagcgaagacaatctttacaaaaaagtgatgtgattcttaagaaaataagctaacgtatttcttagaagacaagggggaaatgaatgaagaaaaaaaggggtttgcgtctttcgtgctgtttgctgacggtttgttttatgatgttcagcgtgaaagatgcggaagcaatcgggcaagccggatcactgaatgaagctggaacggataaagcgtataaagaacggcagactgaagactccggccgtatcccgctcagaatcatcagcatgaatgatctgcacggaaaaattgatcagcaatatgagcttgaccttaacggagacggtaaaccggatggcactttcggacggatggactacgccgccgcgtacattaaaaaggcgaaagccgagaaagaacacgcctttgtcgtgcatgcgggcgatatgatcgggggcagctctcccgtgtcagccctttttcaggatgaaccgacagtagaactgatggaagacatcggttttgatgtcggaactgtcggcaatcacgaattcgatgaaggaacgaatgagcttaaacggatcatcaatggaggagatcatccggacggtaaggggacaagcggttatgacggccaagatttcccgctcgtctgcgccaactgtaaattgaagtcaggggagtcctttctgccgccgtatgaaatcaaatacgtttccggaattccggtcgcatttatcggggttgtaaccagatcggccgcgggcatggtcattccggacggaattaaaaatattacgtttacggatgaggtaaaggccgtcaatgacgccgccgctgacctgaagaaaaaaggaattaaagcaatcgccgtgctcgcccatatgtctgctgaacaaaatggctcagccatcacgggagaatccgcaaagcttgcaagcggaacagactcagagattgacgtgattttcgccgcgcacaatcataaagtcgtaaacggagaaatcaacggcaagctgatcgtgcaggcatttgaatacggaaaagcaatcggaatcgccgatctcgaactagataaagaatcgaaggatatcgtgaaaaaatcagcggaaatccaatatatcgatcaaagtaaaatcaagcctgatccggatgcggcaggcatattaagcaaatatgaagagaaagtgaaaccgattatcagcgaaacggtcggggaagcggcccgtgatataacgggcgggtattcaaatgacggcgacacggcgctcggaaatctgattgccgacggtatgaaagcgaagatgaaatccgattttgcgcttatgaatgggggaggcatccgggacggcataaaaaaagggacgatcacatggggagacctatataatgtacagccgttcggcaatgtgctgacgaagcttgaaatcaaaggaaaagatttgcgggagatcatcaacgcgcaaatatctccggtgtacggaccggattacagcatcagcggattttcctatacatggaacccggaaaccggacaagcggtggatataaagatggcggacggcacagacatacagcccgaaaaaggatatacagtaacagtcaatcaatttatggcgacagcggcgggggcaaaatacggtccgatcgggaaactcggcaagaatccggtgacggggcctgaggatttggaagcgaccgtagactatgtcaaaagcttttccgcaccgatttcttatcaaaccgacggccgcatccgcacggcatcagccaccgaaacacctgatgacaccggcaatcagccgggaagcggggaaacaccgggcggcaccgggcctgataaaggagaaaaacctcaagcggaaaaacccgctaaaaaaccggatgcagcagaacagcctgatcaagccaaaaaacttgaacgtcctgtcgcagaagaaacagcatctgatacagtgcagtcaattcccgaatcccgtccggcgtctgctgcaaattcggaacaaagcacagaacagactgaaagcggcacacaaaaaggccgcccattgcctgatacttcagcgggcagccatcagacggcattggccggcctggtgatcacgggtgccggcgtatattggcttttcagaaagaaaaggggaacccgcacacgatgaacaaactgaaacatattccgcttctcgtcatcatcgcaggtgttatcatcacatgttacggaagctggaagatcattgattcacatatgaaaacgaaccaatcgcttgaagaagcaaaaaaagcaacagaacctgtcttggaaaagaacgaaacaaaaagcgctgtgctgacacagcgcaaaaaagaatttcaccccgaaacgggtgaggcaagcggcattttagaaatccctgaaattgacgctgagctcccgatcgtcgaagggactgacgcagatgatttagcaaaaggcgtcggacattataaggacagctattatcctggcgatcacggccaaattgtgttatccggccacagggacacggtgttccgccggaccggcgaactgaaaaaaggagacagactgaacgtgattttgtcttacggcacgttttcttataaaatcagccgcacaaaaatcgtcagccgggatgatacgtctgtcatcacccttcaacacaagcgggaggaactgatcctgaccacttgctatccgttttcttacattggaaatgcgccgaaacgatatattatatatgccgacccggtttaagaaaaatacgtttcggtaaaatgagccagatcagccggcatcggcgcctcggcaacgatttcttctcctgagatcggatggacgacactgacttttttggcgtgaagcgcctgcctgtgaaacagcgccctgcttccgccgtacaggtcatcgcccgccaacggatggccgatgcttgccatatgcaccctgatttgatgtgttctcccggtttccagttcaagctctgccaatgtaagctgcgcaccgggatgatagcctttcactttgtaatgggtgacggcggcttgtccgccgggtgatacgcgccgtctgacggaatgtgacctgtcgcggccgatcggcgagtcaaccgtgccttttttcggcgtgacttttccttccgccgcggcgatataggtgcgttttaatgttttggtttcgagctgacggtcaaggattgcatgggccaggcggtgtttcgcaaaaacgaccgcgcctgacgtgtcacggtcaagacggtgaacgtggcgcactttcgcctgttcgccgttgatttgaaaatggtaagcgatcaggttgctgagggttccggtctgaccctcttcatttggatgagtcggcattcccgccggcttatttgcaatcagcatatgactgtcctcaaataaaatgtccggctctccgtattcaggaatcaccgaagaacccgttttttcctgaagatcaatgaataagcggtctccggttttcagtatgatgttgtttttcggggatgtccgattcacctgaatgctttcttggttcatccattccgttatcacgggttttgacgcctggaattcagatttcaggactgaaaacagccattgtccggcgtgtttttccgtaatcaggagttccagaccgcggtcattttgtttcatatcataaagctccttttcaagcggaaagcggctgtttcaataggaaacacttaccttagctttcgcgtttttttctatgctattcttgataaagattaaggatattcacatggcaagaaaggtgattgatgtgagaattgtgaacgcagcgactgacggacaagaaagcgcgatacaagagctttcctctgaattgtttcaaaatgtctttcctctttatttctccgaactggaaattcagcgctttaaaaaaaggggcgtattgtctttacaaaaccaacgttaccaaggaactttaaaagaagcgtttcaaattatggcttgtctgcaaacggtacatatcatgctgtcaaagccgcaccccgtatatgacgtcaaagagcgggcgctgtttgataaaaattgcgctttgctgaatgaatgcggaatgaattttccctttacctatgatgatttcgagacaggggccggatcagaagcctgcggtcacagaaggctgatctgacgggtataaagagccttttgacaggctcttttttgcttccttgacatgataccacaatttctttcctctaactccctttataatgagtcaaatccccgagcataataaaatgcgaaaggggtgctttacaatgagttcaatcaaacaatcaatgactacccacgtggctaccgtttctcccaaccaaacgatccaggaagcggctgcgctgatgcaccagcataatgtcggagcaattcccgtcgttgacggaggggaattaaaaggaatgctgacagaccgtgatatcgcattgagaacaacggctcaaggccgcgacggccaaacacctgtttcacacgtgatgtcttctcaagttgtatccggaaacccggaaatgagtcttgaagaggcgtcacatctgatggcccaacaccaaatccgccgccttcccattgtcgatcaaaatcatctggtcgggatcgttgcgcttggagacttagcggtcgatcagcgttcaaatgagtctgcgggagcggctctttccaatatttccagtcaaaacacacagtaacggatgaagagagcttgcactcatgcaggctcttctttccgtgagaatgttacattttgaatgcaaaagaaattcacggtatagtgtatacataggtcagtacgtttagctaaaggagctgtaaccattgataaaagcattaatctttgattttgacgggttaattttagatacagaaacccatgaatatgaagtgctgcaggaaatgtttgaggaacacggttcaacattgcctttatccgtctggggaaaggttatcggaacggcggcgggatttaagccgttcgcatatttagaggagcagctgggaagaaagctcgatcatgatgaactgacggcgatcaggcgcgggcgcttcgaacagcggatgaagacggaaacggcgcgtcccggagtggaggcttatttagccgcggcaaaagaattaggattgaaggtggggctcgcttccagctcagattttaaatgggtgtcgggccatctgaaggaattaggcctgtttgatgaatttgaagtgattcagacggctgacgacgtagaagaagtgaagcccaatccggagctctatctgaaagctgcggaacatttaggcgttgaaccttctgaatgtcttgcctttgaggattcggtcaacggctcaatcgcagccaaacgcgccggcatgaaatgtgtcatcgtgccgaataaggtaacgagcgccctgttatttgaagaatacgatcacagactggaatcgatggcggaaatggaacttgaattactcttacagcgattgaacgatcaaaacgaaccggcagggggaagcagcattgtctgagaaacttgatctgacccgttttgaaaagaaaatggtcatacggaatatggaagagaaagatatcaacaaaattattgagctgcaaaaggattgttttccggggatggagccgtgggagcctgagcatttaatcagccatctcgcgcactttccggaaggtcagttttgcgccgagtatgaaggggaaattatcggttcatgctcaagcctgatcatcaatttcgatgaatatgatgaccgccacacgtggcaggacattacagacgacggttatatcacgaaccacaacccggacggattgaatctgtacgggattgaggtaatggttcacccggaatacaggcggatgaaaatcggacaccggctgtatgaggcgagaaaagacttggcgagacgattgaatctgaaaagcatcattatcggcgggcggattccgaattatcataagtatgcggaagaaatgacggcgagagcctatgtcgaacaggtgacgcgccatcagatttatgacccggtgctttctttccagctgatgaacggatttacgctcatgcggatcaatccgaattatctcccggatgacaccgcgtccattaaatatgcgacattaatggaatggaacaatgtcgattatctgccgcagtcaaagcgctattacaaatcggcatttccggtgcgcatctgcgtcattcaatatgagatgaaaaagatttattctttcgaggaatttgccaatcaggttgaatattatgtcgatgtggcttcagatgcgagatctgatttcgcggtattcccggagattttcacgacgcagcttatgtcatttctcgaagagcgttctccgagtctggccattcagaggattaccgaatataccgaggactatatcagcctctttacagatctcgcggtgaaatataatgtgaacattatcggcggctcccacttcgttgaagaagaggggaaaatttataacatcgcctacttattcagacgtgacggcacgattgaaaaacaatataagcttcacattacgccgaatgagcggaaatggtggggcatcagcgccggagacagggtgcgcgtatttgatacggactgcggaaagatcgccattcagatctgttacgatatcgaatttccggagcttgcgagaattgccgcggatcaaggggcgaaaattatctttacgccattctgcactgaagaccgccaaggctatttgcgcgtaaggtactgctctcaggcgagagcggttgaaaaccaaatttacaccgtcatctcaggtacggtcggaaacctgccgcaaacagaaaatatggatattcaatacgcgcagtcagccatttttgctccgtctgattttgaattcgccagagacggaatcgtcggtgaaacgaatccgaatatcgaaatggtcgtgatcggggatgtggaccttgaaatcttaagaaggcagcgtgaaaacggaaccgtgcgccagctgaaagaccggcgcaaagatatttaccggattacgcatctgaaatgaaaaaacgcccgctccgcttaaggggcgggtttttttatataaacacttgcgccggccccggtttcgggatatgctcttgtagccctttcgcttactgggagaaagcgtttttttaattgccgccgctttattgactcgcccatgccgcgcctttatattcttattaagaggaaaacttcaccatgagaatcggcgcagaagccgggcagctttcgatacagtgcaatgatattgaaagggagatgagcggtgtggaacatgtacaaaaaaatcagtcactcaaacaaaaggataaagagctgatttggcacgcgatgaaaggggcggagccggatgacagcataatcgtccaaaaaggggaaggcgcctgggttacggatattgacggcaggcggtatttggacggcatgtcaggactgtggtgcgtcaatatcggatacgggagaaaggagcttgccgatgcggcttacagccaattgaaggagcttccgtattatccgctgacccaaagccatcaacccgcgattgagcttgcggaaaaactgaatgaatggctcggcggcgattatgtaatcttcttttccaacagcggatcggaagcaaatgaaaccgcgttcaaaattgcccgccaataccatattgaaaacggcgatcacagccgcttcaaattcatctcccggtacagaggctatcacggcaatacgatgggggcgctcgccgctaccggccaggcgcagagaaaatataaatatgagccgctctcacaaggttttttgcacgcggcgccgcctgatctctatcggaatcccggcgatgccgtcacattggaaagcgcgcatgaaatcgaccggatcatgacgtgggagttaagcgaaacgattgccggcgttattatggaaccgattattacaggcggagggatactgatgcccccggacgggtatatggcaaaggtagaggacatttgccgccgccacggcgcgcttctgatcagtgatgaagtcatttgcggtttcggccgcacgggagagccgttcggatttcagcattacggcgtttcaccggacatcgtcacaatggcaaaaggcattacgagcgcttatctgccgctgtcggcaacggcagtaaaacgggagatttttgaggcgtattcaggcggtgagccgtacggccgcttccggcacgtgaatacattcggaggcaatccggcagcctgcgcccttgctttgaaaaacctgcaattgatggaggacgaaaatctgatcgcccgctcccgggagcttggagaacggctgctccgtgagcttgagccgctcagagaacatccggcggtcggtgatgtacggggcaaaggccttcttgccggcattgagctcgtcaaggacaaaatcacgaaggaacccgctgatgccgcccttgtacagcacgtcatcaccgcctgcagagaaaaaggcctgcttgtcgggaaaaatggtgatactgtagcgggatataataatgtcattcagctgtctccgcctttttgcctgtccgacgaggagctctctttcatcatttcgaccgtcaaggaaagcgtgctgagcattgatttttaatgtaaaggagtaaaacatgagttttcacaaccagaagattctaccggctatccggaacatgaagcaattcgatgcatttttagagagtccgttcttatacggcgtcattttagatatccacctcggtcaattaaaaggtgtcgtgaatgaagcgaaaaaacacggaaaacttctgatggttcacgtcgatttaattcacggcattaagcatgacgaatacggtgcggagtttatttgtcaggatatccggcccgcgggcatcatttcgacgagatccgccgtcatcgtcaaagcgaaacaaaagaaaatatacgcgatccagcgtctgtttctcttggatacgagcgccatggagaaaagcatggaattcgtcggaaagcataagcctgactttatcgaggttctcccgggcatcgttccgactttaatcagagaaattaaagaaatgacggggattccgatttttgccggcggctttatccgcacggagcaggacgttgaaaacgccttgcaggcaggagcaacggccgtgacgacttcagacaccgaactatgggctaaatatgaacattctatgacaaaaaaagattgacaccgcttacacccattgttacaatagacctaggttaatactatgtgatggagacccggagacccacaacagctctttacggaagcaataaagcgtaaagcggtttgttgtgggttttttattctctataactctgtcaaacctgctattttgtcatttaggaggaatgatgatgacagcattttggggagaagtaatcggtacaatgctgcttgttattttcggcggcggcgtttgtgcgggagtcaacttaaagaaatcgctttcataccaatccggatggattgttattgtattcggctggggattgggagtagccatggcggcatatgccgtcggcagcatcagcggcgctcacttgaatccggctttaacgataggccttgcgcttgaaggcagctttccttggaaagacgtccctgtttatattacgggacagatgatcggagcaatgatcggtgcggttgttgtgtaccttcattatctgccgcattggaaggcgacggatgatccggccgctaaactgggcgttttctcgaccggcccgagtattcctcatacatttgggaatatgataagtgaagtcattggtacgtttgtgcttgtgctcggcattttggcaatcggagcgaatgaatttacaaaagggctgaacccgctgattgtcggattcctcatcgttgccatcgggatttctcttggagggacgaccggatatgcgatcaaccctgcgcgggatctggggccgagaatcgctcacgcctttctgccgatcccgaaaaaagggccgtcaaattggaaatatgcctggattcccgtaatcggtccgatcatgggcggtgcgttcggcggcgtattttacaatgccgcgtttaaaggaaatgtgacacctagcttttggtttgtaagcgttataatggttgtagtgcttttcatactctatatttataccaagaaatctcaatcacagaaaacattatcaaattctgaatatatttaaaaaggagagcggcatcatggagacctatattttatcaattgaccaaggcacaacaagttcaagagcgattctttttaataaagaaggaaaaatcgtgcattccgctcaaaaggaattcacacagcatttccctcagccgggctgggtggagcacaatgcgaacgaaatctggggatcggtgctcgccgttatcgcgactgtgatttccgagtccggaatcagcgctgatcaaattgccggtatcggcatcacgaaccaaagggaaacgacggtcgtatgggataaagataccggaaagccggtatacaatgcgattgtgtggcaatcgagacaaacatccggcatttgcgaagagcttcgtgaaaaaggatataatgatacattcagagaaaaaacgggacttttgatcgacccttatttctcaggaacgaaagtcaaatggattcttgacaatgtagaaggcgcgcgggaaaaagcggaaaacggaaatcttctgttcggaacgattgattcatggctcatctggaaaatgtccggaggcgcggcgcacgtaacggattattcaaacgcttcaagaacgctgatgtttaatatccatgaattaaaatgggatgacgagcttcttgatattttaggcgtgccgaaatccatgctgccggaagtgaaaccgtcttctcatgtgtacgcgaaaacggttgattatcatttcttcggtaagaacattccgattgcgggagcggccggagaccagcagtctgcgctgttcggtcaggcgtgctttgaagaaggcatggggaaaaacacatacggcacaggctgctttatgctgatgaataccggagaaaaagccatcacttctgatcacggccttctgacgacaatcgcctggggattagacggaaaagtcgagtatgcattggaaggaagcatctttgtcgcaggttctgccatccaatggctgagagacggcatgcggatgttccaggattcgaaagaaagcgagacatacgcagagcgtgtggattccgctgacggtgtttatgtcgtgcccgctttcgtcggattgggcacaccgtactgggacagtgacgtgcgcggctcagttttcggcctgacacgcggaacgacgaaggagcattttatccgggccacgcttgaatctctcgcatatcaggcgaaagatgtgcttgatgccatggaggctgattcaggcatctctttaaaaacattgcgtgtagacggcggagcggtaaaaaataacttcctcatgcagttccagagcgacttgcttgatgtgccggtcgaacgtccggaaattaatgaaacgacggcgctcggtgccgcgtatttggccggaatcgctgtcggctattggaaggacagcactgaaatcgccgatcagtggaaccttgataagcaattcaaaccggaaatggaagatgaaaaacgcgatgaattgtacggcggatggaaaaaagcagtaaatgcagctatggcttttaaataagataaaattatggtatactgaaaacaagttaataggaacggtcctgagatgaggagagaccacagcaccaaagtgatgacatgcgctttggctgttgtggtctctttttctataccgtgacaacaaggaggaagcgtaatgatgaatcaccaattttcaagtttggaacgggatcatatgctggaagacatgactaaaaaaacatacgatctgtttattataggcggaggtattacgggtgccggtacggcgcttgacgctgcttcaaggggaatgaaagtcgctttgagcgaaatgcaggatttcgcggccggcacatcaagccgatccacaaagcttgtccacggcggtttgcgttatctgaagcaatttgaagtcaaaatggtggctgaagtcggtaaggaacgcgccatcgtgtacgaaaacggcccgcacgtcacgacgccggaatggatgctgctgccgtttcataaaggcggcacgttcggttcattctctacttccatcggcctgcgtgtgtatgactatttagcgggagtaaaaaaatcagagcgcagaagcatgctgtctgctaaagaaacgctgcaaaaagagccgctcgtcaaaaaagacggcttaaaaggcggaggctattatgtagagtaccggacggacgatgcgagactgacgattgaagtcatgaaagaagccgttaaattcggtgcggagcctgtcaactattctaaagtgaaagaactgctttatgaaaaaggaaaagttgtcggcgttttaattgaagatctgctgtcaggcaaggaatacaaagtgtacgccaaaaaaattgtcaatgcgacaggtccgtgggtcgacgagctgagagaaaaagaccacagcaaaagcggaaaacatctccagcacacaaaaggggtccatctcgtattcgaccaatccgtattcccgcttaaacaggcggtgtactttgatacgccggacggccggatggtgttcgccattccgcgtgaaggaaaaacatatgtgggtacgaccgatacggtttacaaacaaaaacttgagcacccgcgcatgacggtgcaggatcgcgattatgtcgtcagctccatcaattatatgttcccggaactgaacattacggcggacgatattgaatcaagctgggccggcctcagaccgcttattcacgaagaagggaaagacccgtctgagatctcccgtaaagatgaaatctggacatctcaatcaggcctgattacgatcgccggaggaaaactgacgggctaccgtaaaatggctgagcacattgtcgatcttgtccgcgaccgcttgaaagaagagggcggccaggacttcggcggctgcaagacgaagacgatgccgatttccggcggacatgtcggcggctctaaaaacttcgagtcatttgtggaagcaaagacaaaagacggcttgaaaatcggtttatcacaggaaaccgctaagcagttagccatcagatacggctctaacgttgaaaatgtattcagccggattgaaggcctgaaagatgaagcggaaaaacgccagattccggttcacattctggcggaagcggcttacagcatcgaagaagaaatggctgcgacacctgccgatttcttcgtccgcagaacgggaagactgttcttcgacatcaaatgggtgcaaacgtataaaacggccgtgattgattacatgagcgaccgattccaatggaatgacgaaacgaaagaaaaacacactgagtggttaaatacgctgctgcacgacgcggttgttccgctcgaacaataataaccggagggctgtgccgaaaaggcatgagcccttcttttatctttttacataaagcatttggttaagttatcaagtgacacgggcagccgcttcatattaaaatatggtcataagctgaaattataggaggacgaacatgagttggagtaagagttacgaacgctggaatcaggccgaacaattagattcagaattgaaaaaattattggcggacgcagaaggaaacgagcagctgctggaagattttttctacaaaaatcttgagttcggaacaggaggcatgagaggagaaatcgggccgggtacgaacagaatgaacatttacacggtccgcaaagcatccgccggacttgcggcgtatatcgcgaaacagggggaagacgcgaaaaaaagaggggttgcgatcgcatatgactcccgtcataaatctcctgagtttgcgatggaagctgcaaaaacccttgcttcccaaggcattcaaacatacgtatttgatgagctccgcccgacgcctgagctgtcttttgcggtgagaaagctgaacgcttatgccggcatcgtcgtgacggccagccataacccgcctgaatataacggatataaagtgtacggcgatgacggcgcacagctgccgccgaaagaagcggacatcgtcattgcggaagtgaatgccatagaaaatgaattaacgattcaagttgaagatgaacagtcgctgaaagaaaaaggtttgattaaaataatcggtgaagaaattgataaaccgtatactgaaaaactgacttccatctccgtacatcccgagctttcggatgaagtggatgtcagcgtcgtgttcactccgctgcacggcacggcaaataaaccggtgcgccgcggtcttgaagcactcggttacaaaaacgtcaccgtcgtaaaggagcaagagctgccggacccggatttttcaaccgtcaaatcgccgaatccggaagagcacgcggcattcgaatatgccattaagctcggagaagaacaaaatgccgatattctcgtcgctacggacccggatgccgaccgtctcggcattgccgtaaaaaacagcgaaggcaagtacacagtgctgacgggaaaccagacaggcgcgcttttattgcattacctgctttccgagaagaaaaaacagggcacccttcctgaaaacggtgtcgtcatgaaaacgattgtcacgagcgaattgggccgcgccgtcgcttcatcgttcggattagatacggttgacacgctgacaggcttcaaatttatcggtgaaaagatcaaagaatatgaaaaatcaggccaatacacgttccagttcgggtatgaagaaagctacggctacttaatcggcgatttcgcgcgtgacaaagacgcgatccaggctgcgctgttagccgtcgaggtatgcgccttttataaaaagcagggcatgtcgctttatgacgcgctgctgtccatttttaaagaatacggatattaccgtgaaggcttgaagtcattgacgttaaaaggaaaacagggagcagagcagatttccgctatcctgacttcattccgaaacgatccgccgaagcagatggccggaaaacaaatcacgcaggctgaagactattcaacgggaaaacggactgtatttgccgatcatcatgaagaagatattgatctgccgaagtcaaatgtcctgaaatatttccttgaagacggctcttggttctgccttcgtccatcaggaacggagccgaaagtgaagttctatttcgccgtgaagggaacttctttacaagacagcgaacagcgtcttgccgcattatctgaagccgtcatgaaaacggtggatgacatagtggaaaaaacgaaataaacaacaaaccgccggaagcgacatccggcggtttttttatacgcctcatccgaaagtatgaggaaaattcatgctgaaaacaaaggaatatacagaaaagaattgatataatatggataattctgattggccggagtgagggaaattgacgaaaacgacggtagaaacgttaaaaacgttaaaagcgattgcggaaaccttaaaccaaaaccacgatttaaaggaagcgcttgataaagtgctccgcgaactgctcagcctgaccggactgcagacagggtggatttttctgattgagccggacgggtcttatacgctcgccgcatccgcttatttaccgccggctctcggtcagcgggaaaatgcactcatgtgcagcggagaatgctattgtctgaccaaattcagcaatggcggattgacaaaggccgtaaacataatgaattgtaaacggattgaatttgcggaacagacgacgaactgccgcgatacggagggcattacccatcatgcgaccgtaccgcttgaggacggcggccggaagttcggtttattaaacgtcgccgcaagtgaaaagacatttttcaacgaagaagaactgcatctgcttgaagcggttgcatttcaaatcggaacggcgattcagcggatgaaattggccgaatttgagcagcagaacgccctgttgatggaaagaagcagacttgcgcaagagctgcatgattccgtcaatcagatgctgttttctgtcagcttaacggcaaaagccgcaaagagctttacagatgatgatcggctccggcagatgattacgtttattcaagagctgtctcaggatgcgctaacagaaatgagggcgctcatttggcagctgaagccggaaagtttaacgaaagggctgtatgcgtctatcaaaagctatgccgctcttatcggcctggaagccgtttgtgaaacggaggatgagctggagcttacggatgaacaggaacacgcgctttggcggatcgcccaggaagccttgaataactgtaaaaagcatgcgggaacggaccgggttatcatttccgccgttaaaaagccgggttgcgctgagcttcacattagcgaccgtggagcgggcttcagcgctgatgcgcatgctgtgctcccatcgctcggcgtggccggcatgaaagcgcgggctgaagcgatcggaggccgctttacactgcaatccgagcttggcgccggaacgattgtctccgttcggcttccgtttcgggacaggaggtctgattgatgaaaattgtgattgctgatgatcatcatgttgtccgcaaaggactgcgctatttcttcgccactcaggaagacattgaagttgtcggtgaggcgtccaccggtgctgaagcgcttcagcaagctgaaaagacggagccggacatcattctgatggatttatcaatgcctgatatggacggcatagaagcggcaaaaatcgcggctgaacgatttccggacatcagtatcgtcgttttgacgagctattctgatcaggagcacgtcattcccgcccttaaagccggcgcaaaagcgtatcagctgaaagacgctcagcccgatgatttagtgaaaacgctccgggaagtgtattccggacgttaccggctgtcggcggatattgtgcctcacgtgctgacccatatggttcaggatgatcaggataaggaaaaatattatcagctgaccccccgtgaaaaagatgttcttcaagaaatagccaaaggaaaaagcaataaggaaattgcggcggccctgtttatttcagaaaaaacagtgaagacccacgtgtccaacctgctgtcaaagctgaatctttccgaccggacgcaggcggcattgtatgcggtaaaatataatgtttttggaaaggcggtaaaatcatgagcatattagtgatcagcggcacaccgagaaaaaacgggcggactagaattgccgcttcttatatcagagatcggtttcataccgattttattgatttgagcgaaagtgaactgccgctttataacggtgaagaagaacagaacgagctgtcttcagtgcaaaagttaaggcggcaggtgaaaaagtcggcggccgtcgtcttattatctcccgagtatcacagcggcatgagcggcgctttaaaaaacgccatcgattttttaagcagcgatcactgggcatacaaaccggtggccatcattgccgcggcgggcggaggaaaaggaggcatgaacgcgctggcgaatatgcggacggtcatgcggggcgtctatgcaaatgtcatcccgaaacagctggtcttagacccgattcacatcgacatggagcgccggaccgtatctgaggatatggcggtcagcctgaaagacatgatcgaagagctgaatatgttcacaaacacaagaaatcccggcgtctgacgccgggattgttttatgtcagcatggctaattgatcttcataagcgagttctgtcgcatgatcaatatacccgagtagggaatacagctctttttcaagcaccgcatgatcgtattcgaaatgatacgcgtgcagaaagtgctcaatacgctttgataataaatcatcttttgtacgaaccatcaaaattaataaattgtcccattgagaccggtgtgtgtaatacaaggctttatcataatcggcatgatccatcttacgcttctcctttcaatgagaagttctccgttagtttatgccgccgaagcccggatgcaacgggggaaaacttggtgtccttatcattgcggcatagcaatatgagggagacataaaataaaaccgcatatccgtctcttctttggacacgctaagattgacaaaaaacgactcaggagaacataaagatgaaatcccttccatttgcgcttgccctcttgttttgcggcattctcattgcctctatcgctgaaaaagggcatacagaacacctcgatccgtcagttgaaaaatgggaacagctcgcatggaaccagcttgaacgtgaatacaagggggccgagcttaccgattattcgtacatgggccgtacaaaagtgaaccgggaacagacgaaagacgtgtttcgcgtaacggtgcaaaccgcaaaagaaacgttttcatcccgtgctgaagtgtatttccatcccgtaacaaaacacgtgatcagcatcaatattttcagactgtaaaaaagctgcacagccttatgcggccgtacagcttatcagatatcagaagaaacgttttgcgccgaggtagcgctgtttccaataggaattgttcatgctggaaataacgacacccgaatcgttggcattaataaactggccgttcccgagataaataccgacgtgggaaggtccggctttataagttgagaaaaagacaaagtcaccgaccgccggctggctgactgatgtcatcgtattccagtagcctgcggctgaaagtctggatacagaagtgaccttattgagaacgtaataaatgaaaccgctgcagtcaaagcctctcggcgtcgtcccgccccatacatacggtacgcccagctgagcttttgcggcatcgatcattacattaatcttcgcgcttgttgaacctgtgccgccggactgattcggtgtcgtgtttgtctgctgcccggtaatcgtcagcttctgtccgatttgtagaacgtctgttttcagattgtttttctcgcggatctgctgggcggttacattgaacttttgggcgatcacccataaagaatccccgcttttcacggtatatgtagtggttttccctgtatttccggactggttcggagctgacggtgaagacgaagagccggaagaagacgttttggtcagcttcagcacttgtccgacccgcagcatgtctgacgtcagtttgttgatgcttctgatttgctgaaccgtcatattgtatgcgtttgcgattttccagagtgagtctccgctttttactgtataggaggacgtttgcgtctggtttttattttggtttgaattgtcttttgacggcgtgtttcccgaagaagacgttccttttgttttcaggacttggtttacgtagatcgtatccgtttttaagttgtttaatactttgagttccgcaatggtcatattgacgctgtttgcgatcttccatagggaatcgccgagttttactttataggtcccggaagatgatgactgatttttgctgctgtttgagctgctgcccggcgcggtttttttctgatcggtgcttgaggaaactttccccgtcacttgcagcttctgtccggcgcggattaagtcgcttgtcagaccgttcaattttttcagttcctgtacggacattttaaaatcagatgcgatcagccacagcgaatcgccgtttttcactgtataaacgcttttagtcgtgccgctgttctttgaagatggctttttgctgccggaatctgatttgccgttagggatggtgagcgtctgcccgatagaaataacggtggattttagatgattcgctgatgtaatggcatccacgcttgtattgtagttttgggcaagcttccataatgaatctccgcttttaaccttaatcgtttgtgcttctgccggtgttacagctaacgcagacccgacgatcgcagatgcagtcaaaccgaccgctaccttttttttcatagtgaatctcccttttcctgcgataatttttctatccccattcgttgcagccgcaaggtgaggatatcagtaatgataatctttatatcggcacttgtctgcaatcgtttatcatattaatagaaatagtccttttttcttatgccggcataaaaaaaagaaggaatgcggacattccttcagcttctgagcagtctcataatctcctctttgtttttgaccagatcccttaacgtatatttgtctaaaacggccaggtaagcttgcagggcttcattcagaaggttctttaagttgcaggcgggagatatgatacagagattttttttggagtcaaagcattctacgatgttaaagtcgtcttctgtatttcgaacgacttctccaatgtttatgtcttccggtgtcattcctaatcgaattccgcctccccggccccggatcgtttcgacatacccgagctggccgagacggtaaatgactttcatgaggtggtttttagagatggaataagtatctgcgatttcttttatgttggaaagttcgtcggaatgtctggaagccaaaaaaatcaaaacgcgtaaagagtaatcggtatagttcgttaatttcatagaatgacctcgaaaaaagagattttgcttctgttacagtctatcatatatgaatctaaaatgaaaaaaaaggaatttgctcccttaacttttaaaaaaaaacgtgcgctccttctgagcacacgtttttttcgttaagacatcggcggcttacgatcgtcagccgattgatgtttttcaattttgcgatccaattttgcgagataacgggaggcaaattcttttccgccaagcccgaatgaaagtccgaaggcaagcgcgaaaccgcccagaatcagaataaacgcggcatttacgatcgtgtcggcgacaccgagctgatccagcgccataaagattgagagagtgataatggtatatttggcaagcggggccaggaatctgaattcctttccgctcagcatgccggcaagcagcctgctgacgagctgtccggccaaaagtccgattccgagaataaatacagcggccagaacattaggcaggtaagcgataataccggttgcgataacgacgagaaattcgagatgaacaagctgcagcgcctctgccgtaaagagcaggacgatgatgatctgaacaatcatgccgaccgtctgagaaagcgtcagcttcggggtgcccgcctgttcaaagcccattttaccgagaagagagtcgaaaccggcccggtgcaggagcccggatacaatgctgttgacccattttccgacccagatgccggcgatgatcagcacaataccgatgatgatattaggtagcattgtgaagaccgtgtgcagcatggctgacgccggttcagaaatacccgccacatcaagccggtcaagcgcagagatgatcaccggaatgaaaatcagcacgtagacaatcgttccgatgattgccgacaggctcgtatccttcagataaattgaaagccccatacgtgcggcgagcctttccgtgccgatactcgccagaaagtttgtgacgatatcacggacgagacgggcaacaagccagccgattaaaacaatcagcgccgcggcgaataatttcggtataaaggacaaaacgctttggatcatatttgtaaacggccctgatactccgctgatttggagagcggacaagacgccgggcaggaacaagagcaagacgaagtaaaaaacgattcgtgaagcggccgtaacggatctgctcatctccgcttcttcagacaccattgtccattttctgagccgggcgttttcagcgagtttcatgcccgcttttttgacgagatagctgaaaagcgaagcggccgcccagcccacgagcagaatcaagccggcttttaagacgctcggcacagccgccgttatcgccgacagcatgctgacaaaaggcgaagccacggttgtcagatgcagaatgttaaagaatagaataaaaacgatgattaatgcgataaaataaatgactttactgatgactttttctgaggaatagcgcgccggctttttttcggcgaagagcctgtcgtcgatttttgttttttgcaggcctttgtatacggctttttcaatgattttggcaatgccccagccgataagcaggacgagcagtgcaatgatcagattcgggagtttgttgagatacgtcgtaagcatgtctgctgtattcaagtagaatcgctccttttctttttggggtatggtgtgtgttttacccacttacatataaagcaaacggggcggatgtgccgaaagttttcagtcggaaaccggcctgttatttcatcttttgagaggaggggtcatacattataaataagtccaagtaggggggattcgcttgaacgcggaggagacaaaaggtttacagcgggcaattgaggaaataaccgacattgcgaagggtttcggccttgatttctacccgatgagatatgaaatttgcccggctgaaattatttatacattcggcgcgtacggcatgccgacgagattcagccactggagtttcggcaaacaatttcataagatgaaactccattatgatctcggtttgagcaaaatttatgaacttgtcattaattccaacccttgctacgcttttttgctggacagcaattcgctgatccaaaataaattaattgtagctcatgttcttgcccattgtgattttttcaaaaataactgccgctttcaaaatacgaaccgggacatggttgagagtatggcggctgcggcggagcggattaagcattatgaaagaattcatgggataaaagaggtggagtcctttttagatgccattctggcgattcaggagcatatcgatccgtcgcttgtcaggccgaagctgctgtggagcgtcgatgacgaagaggaggacgaagaagaaaccgcgccatcgccttacgatgatttatggggaatggataagccgaagcaggtgaaaaagaaaaaagggaaaaaaccgtttccgccccggccggaaaaagatattctgctgtttatcgaagaacattcgcgggagcttgaaccgtggcagcgtgacattttaaccatgatgagagaagaaatgctgtatttctggcctcagctggaaacgaaaatcatgaacgaaggctgggcatcctattggcatcagcggattatccgcgagcttgacctgacttcagatgaagccatcgaatttgcgaagctgaacgcaggcgtcgttcagccgtcaaaaacgggaatcaacccgtattatttagggctgaaaatttttgaagacatcgaagagcgttatgacaacccgacagatgaaatgaaaaaaacaggggtaaagcccggttccggccgcgagaaaatgtttgaggtcagggaaattgaatcggatatctcatttatccgcaattatttgacgaaagatctcgtcatgcgtgaggatttgtatttattccaaaagcagggcagggactataaagtgatcgacaaagaatggaaggccgtgcgcgaccagctcgtgaacatgcgggtcaacgggggatttccttatctgaccgtcaatgacggggattacctgaagaataatgagctttatattaaacattggtatgagggaattgagcttgatctgaaatacttggagaaagtgctgccgtatctgtaccagctgtggggcaggagcgtgcacatcgaatctgttcttgaagacagagaagtgatgttctcgtatgacggcaaaggagtgcaccggagatatctgtaaaagaagaaaggatgcggggaaacccccgcatccttttttattttccgtgtttcaggatgtgaaaaatctttttggcctggtccgtgttgtttaaaagccccgtaaatgactctcttcccggaccgtatgcgtaaacgggaacttcttcgcccgtatgatcgccggttgtccagccgctgttggttttcgcattaaaaagcttaatgatcgatttgtagacgctcttgtcagcatcctgttttgcggccgtttcgatctgtttaatttcagcttttgaccatttcaggtctgtataacgcgcaagcacggaagatacggatttgcccgctttgatttggtcagccataaatgccggggttttcttggcggcaagaatcggttcaacatgccagtttttatcgtcatttgcgccgatcgtcaatccgccggtggtatgatcagccgtggcaacgacaagcgtatgtttgtcctttttggcaaatgcgatcgctgctttatatgctttttcaaaatccttcatttcactcattgcgccgactatatcattgtcatgtcccgcccagtctatttggctgccttcgaccattaagaagaacccttttttattcttgttcagcctgtcgatcgccgccgttgtcatgtcttctaatgaagggacggcgtttgaccgatcgattgctttatcgagtccgccatcggcaaacaggccgagaatcttcttgttacgatcttttttcagctcctgttttgatgtcacatagctgtatcccgcttttttgaaatcctttgttacattgcggtctttacggataaagtttgatttgccgcctccgaggagcacatcgactttttgttttccgttgatgcggtcatcaaagtagctgcttgcgatgtcatccatattctttcgggatttgttatgggctccgaatgccgcaggggtggcgtgggcaatctccgaagttgcgacaagtccggtggatttccctctttgtttcgcttcttcgaggacggatttgacccgctttccttttttatcgactccgatcgccgcgttatacgttttcacgcccgtagccattgccgtgccagccgccgcggaatcggtaatattggaatcaggatcgtcaggataagtcatcatcataccggcgagattggggtcgaatgccgtcagtttcataccatccgaaggctttcctttgttaatgaccgaacggtaggcgttcatatagggagcgcccattccgtcgccgaccatgaagatgacgtttctgatctcgtttttgtcaggctgtttttttgccgcagcctgttcagagtgctgaaaccccgcgcccgcaatcagaccggctgtcagcacggatacggctgccgccggcagaagttttgatcgaacctgtttaaatagactcattctcactcgtcctcctttaatcgtgtctgcatgtctaatggtagggggtgtttgtaaagagcgcctgtttctcctgtaaatttcaggtgaaacattgttagaaatgtaaattccggtgtaacttatgttttcaagaaagggtgaaaaccattcacttttttgaaaaagacgaggatttttttaacaaggagttatttggaaagtaaacttctttgtttttccaaaatacgaggatcacaggaaaaaaacatgacaaattgactcgtttttcgtcacgtttgaaatcaaattgaaatatttaatacccttaaaaacttttttcaaaaacgaattagtaagaaatttgtcacgggaagtcaagtctatttctagtggaaattgaaccttataataggaaacagataaaaacattaaaaaagagacacataaaatagatagaatcattcagggaggaaaatatgaaaaagcaacttgttacagcaacaacggcagtggttttggggacgactttgtttgcgggcgcggcatctgcgcaaacgattaaggtaaaaaaaggcgatacattatggggactttcaaatcggtatggaacgtcaattaattccattaaatctgagaacaaattaaaatcggatatcatttacatcggtcagacgctttcgatcaacggtaaatcatcttcaggttcaaattcgggcagcaagtcatcatcgtctacatataaagtcgtaaaaggcgacagcctttggaaaattgcgaataaatataaaatgacggtaaaccaattaaaaagtttaaacggtttaaaaacggacctgatccgcatcgggcaagtgcttaaagtaaaaggatcaacttccggttcagcgtcttcaggatcttcgtcatcaaagaagccttcatccagccataatattgcacagacgagcctgaatgtaaacaagctgatttctgatgcgcaatctttaatcggcacgccgtatgtatggggcggaacaacgacttccggctttgactgcagcggatttatctggtacctgttaaacaaacagacgagtgtcggcagaacaagcactgcgggatactggagctcaatgaagagcgtgtccagcccgtcaagaggagacttcgtcttctttacaacatatcaggccggcccttcacacatgggtgtgtacatcggaaacaacaagttcatccatgccggttctgacggcgtcacaacaagtgatctgaataacagctactggaagccgcgctacctgggcgcgaaaagattctagcagtgagagaacccgttcatccgaacgggttttttatttagacggggcagagctccatttgtttcacctaaaaatgaaaatgtgataaaaaatctaaaaaggttttctttttttcattttcatagagggcgatggcgtacgcgcccgcgctcggcatctgggcgaattcgcacggaatttcaatcatgctgcctgcggcgagttcggaccgtaccgctgacagcggcagaaatgagacgcccagcccctctttaataaatcgtttcgtaatatgcgtctgtgtcaccttcattgttctgacgaaagggaactgtattctgacctggcggagcaaatcatcccaatagtcaggatggttatgggtcaaaagcagatattgtccgaacaggtctttcacttcatccgccttccctgtcccgggttttcggccgggtggcgcgacgaggacaacggggtcattgtacagggggcggcaagtgagggaagatgattgcacctttaaacagctcagtccgatatcggctgagccgtttctgatttgagaggcgatttcttccgattcgaaaatggtgaccgtcatttcggtttctttattgtcctctgtataacgcttcatgacagacgggagaacggtgtcggcgataagcggcgaaacagcgagtgtcagcgtgtgcgagtagccctggcgcaccctgtgcagctccgccatgctgttttcatagtcttccaaaagtctcatggcaaacggcacgtatgcttttccttcttccgtcaattgtattttccggccgctccgctgaaacagcttgcagctgatttctttctctaataattttatatgaacggtgacggtcggctgagataaaaaaagcgtttccgccgtttttctgaaattctcgtattttgccgcggtgacgaaggtgtgaagccatttaaaatccatagatgcactcctctgattaaaagttttaattaattcccttaaaaatattcattattttttaaatattatatttactataataacagaaagaggataagggggaatgaaattgatttatcgtggattgaaagggattacttgtgcagaaacggcgatcagccacattgacggagaaaaggggcatttaatatatcgcggctatgacgcgaaggatatcgcattgcaattcagttttgaagaagcggcgtatctcattttgaacggggcgcttcctgatgagcggcaattgcttgcgtttcaggaagaacttgcagccgagcgcgggcttccgaaacatttgatcggcttactggaaacgcttccggatgaaatggacgacatggcggtgctgagaacggctgtttcgggtttgggcacagattcatttacatatccgcccaagccggaagaagcgattaaactgattgccgtcacaccgacgattattgcgtacagatatcgccgtaaacaagggcaggaagcgctgtcacctgaggcgcgatacggacacgttgaaaactatttgtatatgctgacaggcaggcagccgtccgcagcccaaaagaaagcgcttgagacgtatatgattctggcgatggaacacgggatgaatgcatcgactttttcagcgagagtcacggtttcgactgaatcggacttagtgtctgccgtcactgccgcactgggtacgatgaaagggccgctgcacggaggcgcgccttcaggcgtcacgaaaatgcttgaagacatcggggaaaaagaaaatgcagaagcgtatttgacagcgaagcttatgaggggagaacgcctgatgggcttcgggcacagggtgtacaaaacaaaagacccgcgggcggaagcgctgcgcataaaggctgaagaagtggcgggaaatgatccgtcgcttgacttggcgctttatgtggagaaggaagccatccgcttgttagagcaatataagcccggacggaagctgtatacgaatgtggagttttacgcagcggctgtgatgcaggccattgatgtcgacaatgatttatttacgccgaccttttcagcaagcagaatggcaggctggtgcgcacatgtgcttgaacagtccgctgacaacatgatttacagaccgtctgcgaaatacaccggcgcttttcccgaaacggctcagcagctttaattaccggcatatttgtccgtttaactccccgcactgcgtggtatcgtctcagtaataccaattgcaggagtgtgagaatatgaatccgatagacagacagacggaaggacaaaagccgcaggtgcaaaaccgccagcccggaatggagtcagacatggagccgaagccgctcttggaggacccggatgtaaaagggtcgggcagattaaaaggaaaagtcgccgttattacgggcggagacagcggcatcggcgcagcggctgcgatcgcttacgcgaaggaaggggcggatcttgccatcctgtacctagacgaacatgccgatgccgagagaacgaaaaagcgtgcggaagaataccaggccgaatgcctgttaattccgggagacgtcggtgatgaggcgcattgtcagaaggcggtccggcaagtcttagatcactacggaaaaatagaaattctcgttaataatgcggctgagcagcatccgcaaaacgggattcttgatattacggctgaacagctggagaagacattccgtacaaacatgttttctatgtttcatatgactaaagctgtgctgcctcatctcaaaagagggagcgccatcattaatacaacgtcgattaccgcttatcagggagacacatcattgatcgactattcgtgcacgaaaggcggcatcgtttcctttacgcgttcaatggcgatgtcattggccgatcaggggatcagagtaaatgcggtggcacccgggccgatctggaccgccctgattccggcaacgtttactgaagaaaaggtggaaaagcacggtctggacactccgatgggaagaccgggacagcctgtggaacacgccggagcttacgtgcttctggcttcagacgaatcttcctatatgactgggcagaccattcacgtaaatggcggcaggtttatttcaacataatacgcaagtcttatcccgcgcttttaaaaagtgcgggatttttatttgattacatatgaatacgatttttaaaaaatggaagtctccagccgaatcaccaatgttaatatttcacagcagagaatccgctgagttctgttttatgaaaactgaaataatatatagaattttcaaaaagttattttcatttttatatttttcgctataatatgatgtaggagaaaggaatgatgtgctgaaacatttcatgcgaaaaataagaatttagtcattattgctattgttatctgaatattctaacatatattgatttacaaggagtgaagcagatgaaggggagcatattcagaaagaaaagcattcaggacctgcttgccgcaacgggcggggaaaagtcgctgaaaagagagttaggggcctttgatttgacccttctggggataggggccatcatcggaacgggaatttttgtattaaccggaacaggcgctgtcacggcgggaccggggctgaccgtttcatttgtcatcgccgctcttgcgtgtttatttgcggctttatcatatgccgaatttgcttcaagcgtcccggtttccggttccgtctacacgtttacttatgcgacactgggtgaacttctcgcatttatcatcggatgggatttaatcttagaatatatgctcgccgtcagcgcggtttcggtcggctggtccggctattttcaatcattcttggcgggcttcggcattcatcttccgaccgcattaacggccgcgccgggatctattaaaggcacggtcacattctttaatctccccgcatttgttatcgtgcttgcgattacattcctcctctacttaggcattaaggaatcgaagcgggtcaataatattatggtcattttgaaggttctggttgttctattgtttatcgccgttgcggccgtatatgtcaaacctcacaactggcagccgtttataccgatggggttcggcggtgttttcagtgccgcggcgctcgttttcttctcttttatcggttttgacgccgtctcttctgccgctgaagaaacgaaaaatccggcgaaggatctgccgaaaggaattatcttttcattaatcgtctgcactgtgctgtatgtgaccgtatcggcgattatgacgggcgtcgttccgtttgcccgctttgaaggcgttgaccatcccgtgtctctcgtcctgcagatggccggacagaattgggtggccgggattattgatatcggtgcagtgttgggaatgacaacggtgatgctcgtcatgctgtacggccagacgagggtgatgtttgccatgtctcgtgacggtttggtgccgggggcgctttcaaaagtccatccgaagcataaaacgccgcacgtggtgacatgggtgttcggcatcctgtcggcattactcggctcactcgtcccgcttgatgagctggcgaagctggtgaacatcggcacgcttgccgcatttgtcctgatttcagtagcggttatcgtattgagaaagaaacagcctgatctgccaagagcttttaaatgtccgggggttccctttattccgatattatccattctgttctgcgtatttttaattattaaccttggcgccaccaccatattccgtttctttatctggctgatcatcggtctggtgatttatttcttatattcgagaaagcattcgaaattaaacggggatttgtaaggagcggcacccgccgctcctttttatttttcggaataatgaaacatattgaaatgggcttaagttatcgcagtgaataagggataatatagggcggaagggaagtggaaagtcgtgtctgaccaaaaaagggttcaatgggcctcaaaaataggatttattatggccgctgccggttcggcgatcggcctgggagccatttggaagttcccttacgtagcgggtacgaacggaggaggcgctttttttcttgtattcgtcctctttaccgtgcttttaggctatccgcttttgctcggtgaatttattttcggaagacggagccagacaaatgcgattgatgcctacaaacaagccgcgccgaagtcggtatggcacctcacgggttatgtgggtgtggcggcctgttttttagttttgtctttttacagtgttgtcggcgggtggattttgctttatgtgttaaaagctgttacgggttctttatccgggctcactcaggagcagtacggaacggtgttcgggacggtcattgaaaatccgatccagactctcgccgcgcagcttgtatttatgatcttgaccgtggcggtcgtcgcaaaaggcgtgcagaaagggattgaacgtgtcagtgcggtgctgatgccggttttattcgtgctgtttctattgcttgtgctgcgatcagtcacgctcgatcatgccgttgaggggattagatttttattggttccgcactttgaagatttgacgccggaatccatcctatatgctttaggacaggcgttctttacattaacgctcggcgtttcggtcatggtgacatacagttcgtatctgccgaaaacccaaaaccttccgggatcggcgggttccattgttgtgatgaatgtgctcgtcacgctgtttgcgggactggccatttttccggcggttttttcgttcggatttaaaccggatgaagggcctacactgctgtttaccgtactgccggctgtgtttgaccggctgccgttcggctcgctgttttttatcagctttctggcggtctttttctttgccgcgctgacttcggccttttcgatggtggaaattatcgtagcgactgtcgggaaaggtgatgaaacgaaaaggaagaagctgtcgtggacaagcggtctgctcattttcttagtcggaattccgtcgtgtttatcatacggtgtgctcggtgatgttcatttgttcggaaaaacgttttttgatctagcggatttcacagtgagcaatgtgctgattccgctcggcgctttattaatatcaatcttcatcccgctgaaaataccgaagcgggagctgttcgccgagatgaaaagcggttccgccatcggctatcgtttctttcaggtgtggtatttccttctgaaatatctcgtgccgctggctatcatcgtcgtattgctgcatttaatcggcgttcttccattttaaaaaaacaggcccccgtaaaagggcctgtttttatgtttaaaaaccgaattgcagattcgtatcaacggcaacgatcgtatatacacagacaatgacgaaaaggttgaggatgacaccgagcagtcccgggcccgtccgtccttttttaataaacagctcaatgatgccgaacggcacggcggccatcgcaaacggcagcatctgataagaatagaaagtcacattgctgatgattgccacgttcaaaagcagcagcgacaaaatcgcggtaccgactgatatccagccgaaaacattatgctctttaaaaattcttaccaattccataattccacctcaccgatgtttgctgcttttactgttttgtttttcagcagacgttcgatttcttttgtcggccccgtcacgacagagccgtatacgttcattccgtgatgttcaacatagtcgattcggctgccaagattcatgtctttgcgtttcgatattgcatgagcccattttttatggcgggacataaattcaagggcattgataaattgttcacggtctgtctgtccttgcgtttcgaaagaggacaccatcttggaatctttcccgggaaatcctaacggctcggcataaggactgtctttcagatttttctccgtttcgaccgcgttccataaaaacttcacatcgtattttttaaaagttgaatatacttgggaagaagggtaggcccggtcataagaaagatagacctccgccacgcttccttcaggcaatttttttaatgtctgtccggctttgtcaatcgtgcgttcctttaagccggaaggatgggcgaaataatgttttgactgtgccgcgtctagatcatagtagttaacggcaggcgatttgaccttatctaaaaacatttcaatccgttctccgccgacggatttcgtttttgtgccgatctgcttttgcagcggaaactctgtattcattccaaacagcttcacctggcttttcagtccggaggtatcgacgaggacgttcggcatggtggtcgcgaccgtcacggccgcggtttccattaattgattgccggtgctttcctttcctcccagaccgtaatagaggtagcttcccaaagtgcaaagcggcaaaatcatcaaagtggagatgacggcgagaactgaaatccgcaaatacgatttgcgttttccgtatgacaaaatggccttctgtttttccgggctgatgccgacgtcccattcccggtcgtcctgcatttcgctttcaatcaactcctgatagacttccagcttttccagctcttcttcaaaggcggccatttcccggtcgctcatttctccatttttgtattggtaaaaacgctttttaaattcttcattcatcattaacacctctattataaagtgctttcagccgctgtctggcacgaaataaaacacttttaaaattagcctctgaaatattcataatatgggatgcttctttgtaattcagttcttttaaataatacagtgttaaggcctcccgataattgtcgggaagttcggacatataccctgtcagcacttccttgatttcaatctgatgagccgggctttgaacagccgtctgaaaaaggctcccaattaagtcatcggaaatggtcacttcctttttatgttttctgacataatctataaacgcatttctcgccacttgaaaaagccatggctttactttgctgtggtcgtaggagtgaatgtgtatgtatgccctcataaaggtttcctgcagcaaatcttcagcgagatgcttgtcttttgtcatggagagcaggaaccggtaaacatcattcatatacatttggtaaatttcatcgatcgtcactgccttttctcccctctatgttatacacgcataagaaaggtttaaagttgcacgttccatgcaaacggcttaaattcattttcacctcatcaaacaccatttctctatagtacccaaaatccgtcataaaagatagagatcggcggaggaaaaatatatttattagtaccaggtaataaaaaatattgttataatagagagagaacacttttgatcattacaacaaaggaagtgcgttatgtataagttttgtgcaaatgccatcaaattcattctttctctgcgcggaggagtcaaagtatacaataaagagaatcttccgtctgataaaggattcgttatcgcgtgcacgcatgcgggctgggtggacgtcctcacgctcggtgtcgggatattgccccatcagattcattatatggcgaaaaaagagctgtttcagaaaaagtggatcggaagttttttaaagaagattcacgcgtttccggttgatcgtgaaaatccgggtccgagcagcattaaaacgccgattaagctactgaaggaagggaagattgtcgggatttttccgagcggcacgagaacttctgaagacgtcccgctgaaaagaggggccgtgaccatcgcccaaatggggaaagcgccgctcgttccggccgcatataaagggccgtctacgggaaaagcgctgtttaaaaagggaaaaatgcggcttatcatcggcgagccgatttttttggaggacttttccgatcttgcgccgaaggagaggcttgcggccatgacagaagagctgaatgccagaattaaagagcttgagaaaaaacttgaacaactgtaaatgaaaaaaagcttgccgtctgtatcagacgcgcaagcttttttgttatgcttctttttgttcggcggtttccagcagttcatcaaacgccagttttttcacttcgatatatgcgacgtggtggccgtcaatttcattaatgataaattcgcagccttcttcgataatcgagtcgtattgttcgacgtcgtatttctgggtaaggaaccagccgccgatggtgtcgacctcgtcattttctaaatggatgccgaggagttcgttcacttgatcaatcaggaccttgccgtcaagcatgtaatggccgtcgccgagtttgcggatttcattgatttcatcgatatcaaattcatcacggatttctccgacgatttcttcaataatgtcttcaacggtgacaagccccgcggttccgccgtattcatccgacagaatcgccatatgaacccgttccttctgcatttttacaagcagatcatgaatcggtgccgactcaatcacatggatgatcggattgacaaaatccgtaatcggcgagtcgactgatacttcgccgctgatgcaggcggtcagcacttctttaatgttaataacgccgataatattatctttgtcaccctcttcgacagggtaccgggtatatttttcaatctgaatgatatccatcatttcagaaattttaatatcatgcggcagactgacgatttccgtacgcggaatcatgatttcttttgcaagtctgtcgtcaaattcaaagattttgttcacatatttaaattcagactggttgatttcaccgcttttatagctttccgataaaatgatgcgcagctcttcttcagagtgggcaagctcattttcagacaccgtctccagaccgaacatcttcgttaaaagacgggcggagttgttcagaagccagataaacgggaacatgatgcggtaaaaccaaatgagcggtttcgaaaacagcattgaaacggcttccgctttctggatggcgactgttttcggcgccaattctcccacgaccacgtgtaagaatgtaatgatcgcgtaggcgagaataaatgaaataatatgcgataatgagcttggtacgtttatctttgtgaaaagcggatgaagcaagcgttcaatcgttgattcgcctaagacaccaagaccgatggaagtcaatgttatgccgagctggcacgccgataaatactcatctaaatgcgtggtcacttttttgacaccgattgcggctttatttccttctgctataagctggtcaacccgtgagcctctgattctgattatcgcaaactcagatgctacgaaaaatgccgtcagcgcgattaaaaccgcgactaaaatcaaattcacaatgtccaattagaaccttcacttcttttgggaagatgaaggtaacacctcctgttagtaagataatggtttaacttaacagcagcataaatgattgaagcactgcaagcttttcaggagccagcctttttttcagctgggcgcgctcctctggttcaagcttttcaaaccgattcaagatcccggagatgttttgattcatgtgatcaatttccgatgccagatttccaacatcgtcaggcagggctgaagagggaaactggttctccagtcgatcttttatatcagacagggccaatcgctgctttttacaagcgactataaactttaaccgattaagtgcaagtgtatcgtagtaacgatagttcgaacaagacctgtcaggctttaaaagcccgaggtttgtgtagtaatccaccgtgcgtttcgttacaccggcaagctctgctaattcactgatgcgataagtctcagccccatctaaatccctccccaaccatcacgttatagttatgagaatagtttaatatatgaaggggagtttgcacaagtttattgttttccgtctttctcctgaaacggggcggcaggctgtctgaaaaagcgttgactgcgccatgtaaatctttcataatcattgtaaatagaaacggcagaaaaagacagaagggacagatgacagtggccggtttatcaagggaagtgacacagaatctggagaaaggttcatggatacgcaaactatttgatgaaggcgctcggctgaaaaaagagttcggcgccgataaggtgtttgacttttcgataggaaatccggttgcggagccgcctgaaacatttaaaaaggcgctatgcgaagcggctgaaacaggacggcacggatacatacaaaaccaagggcttccggaggcgagagaaaaggttgcccgctttttgtcagagcggtttcagacagaaatttccgccaggcatacagttatgacggtcggagccggcggggcgctgaatgtcgcgctgaagagcattttaaacccggaggaagaagtcatccttctttcgccttattttgcggaatataaagcgtatgttgaaaattaccgcggcagacccgtcatctgcccgctgactgactcatttgagattgatattgaagcggttaaaggtgcgatcaccccccgtacgaaaggactgatcgttaatacgccgcataatccgacggggactgtgctcagccagaaaaaccttaacgaattgggcgccttattaaaagaagccgaagagcggaacggccaaagcatatttattttatttgatgaaccgtacagccagctgatctacggagaagagcaggcgaatccgtttcaggcgtatcaccgcgtgattttagtcagttcgttcagtaaagatctcggcattgcgggggaaaggctcgggtatatcgcggcggacgcccaaatgcctgagggcgatcttctgacggatgcattcgttttctgcaaccggacgctcggctttgtgaacgctccggtcatgatgcagcgcgccgtggcgaaaatggatgatctttcgattgacgctgaaccttacagaaagcggagagaccttatggtggacatcctcacagaagccggcttcgaatttgaaatgccgaaaggaggctttttcgtctttccgaaatcaccgattgaagacgaagtggcgttctgcatgcatgccgcacagaaatacaaactattgatcgtacctggcagcggatttggaaaaagcggctatttccgattatctttcagcgtgccttcggaacagatcagacagtcgcgcgatattttcaaagcactgtatcaagatttttcttcatagcttccaatacataaagatgggagaacggacacatgtcgaggagaaataatggcacgtcagacatcagcattacaggaatcggagtcttaaccgcggtcggacaaggcaaggaggcgtttctcgctgcgctcatggaggggcggcacgcctttgatgtgatgaaacgccccggccggcagaaaggcagttcgtttatcggcgcggagcttagcgaattaacgccgccggacgcgctgtcgaagcgcttgtaccgaagggccgcattatcaggaaagacggcgcttatcgctttatatgaagcgtggcatgacgctcaattagacggcgctgatcacagccgcaccggtctgatcatcggcgggtcgaatatgacgcagcgcgaattgctgcaggcctttgagaaaaacggtgaaacgccgcaatttgtaaatccgacatacgggctttcttttatggatagtgatttgtcggggctttgcacggagcaattcgggataaaagggccggcctttacggtcggcggcgcgtcggcaagcggccaggcagcggttatccaggctgctcaaggaatcataggaggcctgtttgaccggtgcatcgtgatcggggcgctggccgatctgtcgtacatggagtgtcacgctctccgttctttgggagcgatgggcactgatacatacgctgaacggcctgaagccgcctgccgcccgtttgaccggcatacggacgggtttatattcggagaggcgtgcggggcgattgtgctggaacgcgctgaatctgccgaagagaggggcgcacgatcgtgggccggcttaaagggctgggggatggcttccgatgccaaccgcaacccgaatccttcagcagagggcgaaatgacggtgatccgccaggcgctggagcgggccggtctttcagcgaaagagattgattacatcaacccgcacggcactggttcgccgatcggagataagactgaatgccgggcgctttctgaaagcggcctgtcgcacgcgcggattaatgcgacaaaatcgattaccggacacggtctgagtgcggccggaacggtggaaatcattgctgttctcttgcaaatgcgggaaaacaagcttcatccgatccgaaacttaacggagccgattgacgattcatttcagtgggtgaccgacgggccgagcgcccataccgtacaccatgcgttaagcttaagcatgggattcgggggattaatacggcgctttgtttagaaaatcatttccgaagcagataacggcagccttctttttgaaggctgtttttatatgatgaaaaatctgaaaatgatgaaagaatggagttgtgatacaataaactatacaaatgacaatcatgctttgacttaggaggtggcaggatggggccctctgtgtagtcaatcacccatttcgttcctctcgcttaagaaaaaacgatgaaatcaggaggtgacgtccttatccttcaattcgggataaggtgaaatggacgatattgacagtttgattttaatcggtgtgctcattgcgttaacggcgtttttcgtggcgagtgaatttgcgatcgtcagagtgaggagatccagaatcgatcagctcatctcagaagggaacagacgggcggtgctcgcaaagcgtatcattacggatcttgatgagtatttatccgcctcgcagcttggcattacactcacatccatcgggctcggcgtactgggagagcctgcatttgagcggatgcttcatcctgtgtttcagggcatggggctgccggattcagccgagcatgtgattgcttttgctgcggcgtacgggctgattacgtttttacatgtcgtcgtcggtgagcttgcgcctaaaacggttgcgattcaaaaagcggaaaagctgacgttatggattgccggaccgcttcggttattttacgtgttcatgttcccgtttatttgggtgctgaacggctccgcgagaattctgaccggtttggccggattaaagccggcatctgagcatgaaggctcccactctgaagaagagctgcggatcctgctgtcagaaagtttaaaaaacggagaaatcaatccgtctgaatatacatttgtgaataaaatttttgattttgataatcggatcgccaaggaaatcatgatcccgagaaaagaaatcgcggctgtttccactgatatggacgtgccggaaatgcttgatatgatgctgaaagacaaatatacgcgctggcccgtaacggacggggacaaagacagtgtcatcggcatgatcaatacgaagcatctcttttcagatctgctgtttatgacagaagatgaaaaagcggaagtatccatcatgtcttacgtccgcccggtgattgaagtcatcgagacgatcccgatacacgacctgctgataaaaatgcagagagaacggattcatttggcgatattgtctgatgaatacggcggaacgtccggtcttgtgacgaccgaagacatacttgaagaaatcgtcggcgatatcagagacgaatttgatgaggacgaacagccgcagattcaaaagctgtccgaacgccattatgtgctggacggaaaggttcggatcgatcaggtgaatcatcttctcggcgcagagattgaagaggaagtcgatacgatcggcggtcttgtgctgaaacggaatattgacatttgtgcgggtgagtcgatacaaatcgggggatacactgccctcatattagaaatggacggccggtttattaaacagcttgaactcaaagaagaacagggccgcccgggcggtcaggggacaataaaccgcccgctgcccgtgcctgaaacggtcatgcttcataacgcaaccttgagcgaaaaataagctcaaggtttttttaaatggttatcataacaaagccgcaccagaacgccaaaaggcttccggctgctgaaacagcgatgtagagcagactttcctttatgcggttgttcatcatcagctgcacggcttcaatactgaatgtggaaaaggtcgtaaacgcaccgaaaaagcccgtcgcgatgatgatgccggcagaaggattatccagacccaatccggtgaatatgccgaggccgaaggagccgagcaggttgaccgcagccattccaagcggaatcggaaaaccttttgttctttctgaaattgttttacccagcagagaccgtaataccgctccgatacccgccgcgataagcatcaggacaatcgtcatggcgtatcatgcccccttcccgctgcgtgaagggcaatccgccgtccccaaaaaatgccggcgtatgcaagggcaagaccagcgaataaagtcgcggcagcataacaaaaagccgctgcgggagacgattgcagcagaaaaacggtttcttttgcgaaggttgacatcgtcgtgaaacctccgcaaaaaccggttcctaaaaaggcggtaaaaagagggcgtttagcccgaatgatgaaataacccgtaataagaccgagtaaaaggcttcccgccgcgttttcgaggaaagtggcacccgggaaagatccgctgtgaatgtgcgcgctcatttcaaagcggagcaatgcgccaagcgcgcctccgataaaaattgcgatgtattgtttcatatcagccatccttagaaataatatccggaaaatcagttacaatgccgtcaactgccatcatttgcagcttttcggccgtcttgtgatttctgaccgtccaggcaaatactttcaggccgtgtttgtgagcggtggaaatcaagaaccgattcaggcgggtatatttaatattgacataatttgcggctgatttgtaagcggccagctggcttttggaaaacatcccgaagctgggtcttgcgataattgcagtcggaacggacggatacatgtcgtgaaaggtctgaatcgatttgagactgaatgattgaacgatagggtggatggaaaaggtaaacctgcttaacagctggccgactgctttttcaagaccgacttgagaaatgtgccctttcagttcaattaaaaaaccgatttcagaatgataacgcttcagaacctcttcgagcaggggaatccgctcccctttaaactcagccccataccagctgccggcgtccagagattgcagcttcttcagcgtaaaatcttttacaaaaccggagccgtccgtcgtccggtcgactttgtcatcatggatgacgacaatctggccgtcttttgtgagctggacgtcaagctcaatgaaatcagcgttcatttcggcagcgatatcaaatgccgcaaatgtattttcgggcgcgtaaccggatgcgccgcgatgagcgatggtatacaagcttgtcagctcccctcatgggcatttctgttattatatcagattcgtatatgcacagcgattcaaactggtgaatgtgcaaaacagtatttttttggaataaagatagtgcttttttcggtttacaatccgcagtgatgttttataatggcaaaaaggaggcgagatcatgggaaaagggagattgaaagtggaagaaagaattaaggccgaaaccgatgctgaaatccaaaaagcgactctcctgaaacagacacaatcaaagaagaaatagtgcctgaccctgttgtatctggctgaaagatgaacgaatgtgtgaaaaccccggctgtgctctgatgccggggtttttcaggctgcctaaagacattaaaacaggctgatgtccgaatgttttagtataatagattttcgacaagacaaaggagcatatgccatgatgacacaatttcagagcttttttactcttgaccatattttgcagatcagtatcagcatcggaattttagcggcttttctcgttttgagaaaactgtttgtcaaatacttttttcagctcatttacaaattggcgaacaagccgaaaaccgacatattcaaacagattgccgtagcgtttgacaagccggccagatggtttttcgtggcgctgggtctgtttttggcgattgagtattcgccgtttttagacggacagatggatattgtcaaaaaaatgtaccgctctttgatcatagcgctgatcgcctgggggctttgcaacctgacatcggcgtcttcgtttttatttcataaagtcaatcagcgctttgagctggatatggatgacattttggcgccgtttttatccaaggtgctgcgctttgtcattctcgcgctcagcgtcagtgtgatcgcgcaggaattcaattatgatgtaaacgggttcgtggccggactcggacttggcggcttggccttcgcgcttgcggctaaagatacgatcagcaattttttcggcggcattatcatcattacggaaaagccgtttacgatcggcgactgggtcgagacgtcatctgtgacggggggcgttgaagatatcacattccgaagcacaaggttccggacggcgcagggggcgcttgttaccgtacccaattcaacgctgtccatggaagccatcacaaactggacgaggatgacgaagcgccaggtcacgttttccgttcgtgtttcttatgcgacgccgattgatcgtttagagcggtgtatcacaaggctcagagaaatgcttcgtgaacatgaaggcgtgcatgatgatacgattatggttaactttgacgtgtttgcggacagctattacaatctgtttttcaacttttacacaaagaccatcgtctgggcggaaagcctggacgtgcggcaggatatcaaccgccggattattgatatttttgctgaggaaggcgtggagttcgcctatccgggccagaatgtattcgtaaaacagaagagccacgatgatccggttcatgtgaaggatcattccggagaaaaagaacgggcataacaggcgccgttcttttttcatgatatgataaaaagaaaaggcggtggaagagtggaagcgtttataacattgatcaatcaggctgaacgtatcctggtgctgacgggagcgggaatgagcacggaatccggcattcccgattttcgttcggcgggcggtatatggaccgaagacacctccagaatggaagcgatgagcagggaatactttgaacgccgtccgcgtgaattctggcctaaattcaaacagctctttcagatgaaaatgagcggaagctatgagccgaatgccggccatacgtatttggcggatcttgaaaagcggggaaagcaggtagacattttcacgcagaatattgacgggctgcataagaaagcgggaagcagtagtgtctatgagcttcacggttcaattcagaccgccgcatgcccccgctgcggagcgcgctacgggctttctcatctgctgaaggacgaagtgccggaatgtacggccgaaatcggtgatcatgcggtatgcggcaccgtattaaaaacggatgtcgtgctgttcggcgatctcgttcagcattttgaaaccctttatgaaaagcttgataaagccgatcttcttcttgtgatcggcacttcgcttgaagtggcgccggcaaggtttgtccctgaggatgcgggccggattcccggtttgaagcaggtgatcattaaccttgagccgacatattgcgaccatttatttgatcttgtcatccatgagaagatcggtgaatttgcaaaacggatcagcgcttcgacataaaaaaagccggatcatatacagatccggctttttttattcatggacgggaatcatttgatccgtcagaacttcaaaggagtagccctgggctttcagtttttgaatcaggctcggtaaagcgtgcaccgtcgcaggcagatcatgcattaaaatgacatgcggcctgctcgtatgaacgctttccaaatatgcgagctgattcaatacttccggcacgtaccgtgcgtttttgtacttccagtcttcactgtctatcgtccagtcccagtacacgaatccgcctttttcgagattcttaatctgggcatccgtcaatgacggtttactgccgtaaggcgtgcggacaagatccgtttttactccagtgattgcctcgagcgtatcgcgtccctgctgcatttcgttcagcggcgatgtcggtgtttgataaaacaggtgattatcgtgcgtcacgccgtgcaggccgagcgcgattccttcctgcttcgctctttgcacggaatgcttataggctttcatccgcggttcaagcataaaaaaagtggcctttgcgccatttgccttcaatacattcaacagctgttcagtatatggagacggcccgtcgtcgaaggttaaatataccgtttttttccctgggtcacgctctttctgcaaatgtttcattaagacgtcgggagaatcatttttcagccgcaggctttctgcttcatcccgaagctgcccgtttgcggtcacggtgacctgtttgttttttgcggcggaagcggaatatcccattatgacgattaccagaagcagtccgcacaaaactgctaaactcgtaagtttaaaagctaatgaaaacagagaaggggaagcaccttcttttgtgttgcgcataacaatctctccagtagcataagtttctgcataatgccgataacagcggaggcttgcgaagtgccataagttaacagcatatgtatgtcgaatcaagtatacaggaacaaaactggaaaagacatagaaaagatgtcgaataataagattttaagaaaaaaataaactccgcagccggctcgttcagtatgatagaatagttgacaataacagctgagaatgcacatcacggcagataacgattaggagggtttacatgaagacattagtaaacggccagttgattgatcgtgaagaagcggcagttgatattgaggaccgcggatatcaattcggtgacggtgtgtatgaggtcatcagagtgtataacggcgccttattcggtctgcgtgagcatatcgtccgtcttttcagaagcgccgcagaaatcggcatcaccctgccgttctccgcagaggacatagaatgggatctgcaaaagctcgtacaggaaaacaaactcattgacggcggggtctatatacagacgacgagagggaaggcgccgcggaagcaccagtatgacgaaggtttggagccgcagacgacggcatacaccttttcagtgaaaaaaccggaaaatgaacaaaaagccggagcgcaggccatcacggcggaagacaaacgctggctgaggtgtgacattaagagtctgaatttactgtataatgtgatggtaaaacaaaaagcctatgaagcaggcgcttatgaagcggtgctgataagggacggggcggtcacggaaggaacctcatccaatgtatacgccgtcataaacggcaccgtccggacgcatcctgcaaatgagctgattttaaacggcattacgcggatgaaactgttagagctgatgaaagaaaacgggattgaggtgcgggagaaggctcttaccgaagacgaactcagagatgcggatgaaattttcatctcgtcaacgacgtctgaattaatcccgatcgtaacccttgacggaaaaccggtcggaagcggcgcgccgggacctgtagccaaaacgattcaggaggcatttcagtcgcacattcagcaggagctcggcgttcagtcataagctgaaaaaaaggccggaacacatccggcctttttgcttcagtcagataaaaagagattcgatatgctgaacgagcacacgggagatcttctcttttgaaagacgatcaggttcaagcatggcatgcagcgccaatccgtcggcgatagcgtacattttctccgcttcggtttctttatcaagatttggtttcagaagcttattttcatccagccagtcaatcaggccgcggatatatgccaagatcccgtcctgctggggttgaaactcttctcccttatgtctggcataagctgtgaaagcgaaccatacctccatttcagccatcgtttcttcatctgtcgggataatttcaagcatcagacgcaccgctttttctttcggcggcagatctttcatggcaacttcgttaattctggcggccgctttttcttttacgagtgtcatcgcataccctaaaagctcatcctgggtggtgaaatagtgcctcagcgcgcctaaagaaagacccgcttcttgggcgatgtttctcactgtcgctccttccattccccgctccaaaatcgtccgccaagtggcttcggctatttgttttcttcttttttcatgatcgattattttaggcatggttccagtgtaacaggaaatattttttcttgcaattttgtaatacagttgtattaaataaaaagcagtgatacaatgcattttagaaaacgataagggggaaccggattgaacgcgattgcttggttgattgtcatttgtgaggctgctttttgggcggctgtcatcttcggattggcggcgcgctatatattcaggcggcaaaagctcggaatgttttttttcgctctcattcctatattggatgctgtactgtttctggcggccgcagctgatttatacagaggggcggcggcgactatggcgcatgcagtggcggccgtttatatcggagtgtctgtcgccttcggaaaaagcatgattcaatgggcggatgagcggttccgctattatgtggtaaaggaaggggcaaaaccggtcaagcggtacggactggattatgccaaacattatgcaaaaggatggggaagacatgtattagcatttgtcatcggcggcgttcttttagccggaacggtatttctcattcaggacgcttcccgcaccgaagcgctcagcggactgttaaagggctggtctgtcgtattgtgcatcgattttttgatcatggcgagtttttttgtgatgccgaaaaaaagaaaaaacagccgggagctgtaaaaaaaagcagcttttgattaagctgctttacagaaagaattattttacgatcagcacgggaatatcggatttcgatgacagtttttcactgacgcttccgaataaaagttttttcagcctgttctggtcccggctccccatgacgatcaaatccgccgatatacggtcggcatgctcgataatggcatcagcgggatcaccttctaaaatgtcgatatccccgtcaatctggctgtcgttcatcagcattctcgcttccgcaacgatttcttccgtacggtcttcataaatcatcggatcaggggagattctttccgcctggagcgggtcaggaacgcttgcaatcccgccgccgatatacgttgccccggctcccggcctcgggggatcaacaatcgtctgggtatcttttgcattgtgggaatgtacgaccgttaaatctgcgtgaaacgtttttgaaaggtctatggctttttgaagcgcttttttactatcatcacttccgtcaaaagctgctatcaaccggtctgcgtgaaacatcagcctcatcctttcagtaaaaaaggtttgttttacaatacccgtgcagcagaaatgtaaaacctgcattgacagaaaaaggatttgtttatatgatgaaggaacaatatagggaaaaaggaggtatggatcatgtcaaaactaaagcttgtcaactcatcttcagctgaataccggcgtgactcccatacagcttccgttttctgaacatttgcttaaaaacggggcagtcgcgtataaacggcgggtctgtaccttatttataataataagaggcatggagctgaggcttcatgtctttttttatacaaaaaaatgaaagaaagacaggtgtgatgcatgtggcggcattagcgaaaacaatgaaaaacaatccggaaaagcttgagggcggctgattgatgaaaggggatgacggtatttgtttactgtattaaaaaagctcgcgtggttttttaaagcctattggctgcgctatacgacagcgattgttctgttattaattgtgaatgtcattgagatgtttccgcctaaacttctcggtaacgcgatagacgatatgaaggcgggcgtgtttacgaaaagcgggatgctgttttacatatgtgtttttctcgcattaacggcagccgtctatttactgtcttatttttggatgtatcagcttttcggcggggcgaatgtcatggagaagattctccgatcaaaactgatgggaaggcttcttcaaatgtcaccgccgttttacgagaaatacagaacgggcgatttaatggcgcgggggacaaatgacctgcaggccgtcagtatgacgacgggcttcggggtcttaacgctcgttgattcgacgatgtatatgctgacgatatttttgacaatggggcttctcatcagctggaagctgacatttgccgcgattattccgctgccgataatggcggctgcggtcagcctgtacggaaaaaagatccatgagcggtttacggaagcgcaggatgctttcggatcattaaatgacaaggtgctggagtcggtagccggcgtccgggtcatccgggctttcgtacaggaaaaaaatgatgtcagccggttcggtgatatgacggcggatgtatatgagaaaaatatgaaggtggcgtttatcgattcactttttgaaccgactgtgaaacttctcgtcggcctcagctatctcatcggtctcggctacggcgcttatctcgtttttcaaaaccggctgacgctgggagagctggtatcgtttaacgtgtaccttggaatgatgatctggccgatgtttgcgatcggagaattaatcaatatcatgcagcgcggcaatgcctccttggatcgtgtcaatgagacgctttcctatgagcctgacgtgatcgggcccaagcgccccgccggcatcaaggagcccgggcgtcttgtttttgaacaagtgactttcacgtatccgagcggagcgggaccggcggtttccgatgtatctttttccgtagaaaaagggcagacactcggcattgtcgggaagacgggaagcggaaagacgacgatcattaagcagctgttgcgtgaatatccgcccggggcgggagcaatcacgtttacaggcgttccgattcaggagatcccgcttgaggagctccgcgggtggatcggctatgtgccgcaggatcatattttattttctaagactgtaaaggagaatctgctttacggacggcaggatgcaaacgaagaggaaatcggcggcgcgctgaaagatgcgcattttgaaaacgatatcggcatgctttccgacgggcttgagacgcttgtcggcgagaagggcgtagcgctctcgggcggacaaaagcagcgcatttcaattgcgagagcgcttttgaccgatcctgacattctcatattagatgattcgctttctgccgtagacgcgaaaacggaagccgccatcattgacagcatccgtaaaaaacggcggcataaaacaacgattatcaccacccaccggctctcggcagttgaacacgcagatctcattctcgtcatggatgaaggccgggtgtctgaaagaggcacgcaccgggagctattggagcagaacggctggtatcgaaaacaatatgagaggcagcagctgtcctctcttgaagaagggggacgggcgcatgaagaccgggagaagattatggaattacgcgcttcaatataagaagctgctgatatgggcggtcgtcctgctcattattgcggtcggcactgagctgaccggcccgtttatcggaaaaaaaatgattgacgaccacattctcggcattgaaaaaacatgggttaaagcctctgcggacgatccgggcgccgtcaggttccgggggcatgattatgtcagggaggaccggctcaaaccggaggcggataaaaccggagaggcgcacatttatcaagtcggtgcgggctactattttgttgaccgtcccgtcagttttgacggaaaccgttcggtggctgacggccggctgacaatatcaaacggtaaagaaagcaggtcatatcccgccattacgttatcaagacaggagatttttgaattttaccgtccggaaataaaaggattgctgacgttgaccgccatttacgcgggactgctcatgttttccgtatgttttcattacggtcagcattatctgctgcagatgggagcgaaccggatcatacagcgcatgaggcaggatgtattttcacacattcagaaaatgccgatccgctactttgataatctgcctgccggaaaagtcgtggcccgtattacgaatgacacagaagcggtcagggatttatatgtaacggtgctgtcgacatttatcacaagcggcgtttatatgctcggcatttttacggcgctgtttatgcttgacgtcaggctggccgccgtttgtcttctgattattccgattttaatgatctggtcggttgtgtaccgcaaatacgcatccgtcttcaaccaaaaaatccgttccattaacagtgacatcaatgcgaaaatgaacgagtccattcaaggaatgccgattattcaggcgttccgccgcgagaaggaaacgatgaaggaatttgaagaattgaatgaagctcatttccgctacaaaaacaaaatgctgtccttaaattccctcatgtcccacagtcttgtcaatgtgttgcgcaatctggcgtttgtcgggctgatctggtatttcggaggcgcgagtctgagtgcggccggaattgtttcgatcggtgttttatatgcatttgttgattatttaaaccgtttgttccagccggttacgggaattgtcaaccaattttcgaagcttgaattggcccgtgtctctgccgccagagtattcgagcttttacaggaggaggaaacggaagaagaaggcgctcccgcagacagaaaggcggaagggacagtggaattccgcgatgtttcttttggatatcgaaagggagaagaggtgctgaaacacatcagctttacagctgaaaaaggggagacggtcgccctcgtcggccatacggggtccggcaaaagctccatcctgaatcttctgttccgtttttatgatgcccaaaaaggggatatcctgctggacgataaaagcatatacagcatgtcaagacaggagctgagatcccatatggggatcgtgcttcaagatccgtatcttttctctggaacgatcggctccaatgtgaccctcgatgatcagcgtatttctttggagcaggcggaagaagcgcttcgccaagtcggcgccgcaagtcttctgcaatctttgccgaagggcatcagagagcccgtcactgaaaaaggcggcacactgtcctcaggccagcgtcagctgatttcttttgcaagagcgcttgtgttcgatccggccattttaattttggatgaggcgacggcgcacattgacaccgaaacagaagcagtcattcaaaaagcgctgcaagtcgttcaagaagggcgcacgacatttattatcgcccatcggctttccacgatcagacacgcagaccagattctcgtgctggaaaagggccgcatcattgaaaagggaagccatgacgaattaatggcgcaaaaggggcagtaccatcaaatgtatgaattgcagaaaggatcggcgaagtccgcggtgtaatcggaaagggtgaatctaaagagattcgcccttttttcattcagtaagccagtcctacccgttttctgacaaactgcgggctgatcagctcgcggtacagaaaatgcgcagtgtctccgactgtgatttcggcgccgtcttcaggaaggcgatcctgttcgaaccggtaaactccggcagcgtctccgtcaggaaggtaggtagggcagatgatcgtccagtcaagatcctctgccagcagcatctcgtatacgcgggcgtgttcctttgcggctcttgttgattttcgttttgattctgccgattcaaaacggtattgatcaggcataagccgtgattgaaggatacccgcggtgccgatcgtaatcagacgctgaacatgatgccgtttcatgccgtctattatatgggtcatagcggctgaaagggtatcgtcaccgtccgtgccgagacagctcacgactgtgtccgctttggaaatcaatcggcttacatcttcccgccgcctcgcattccctgttatgatctgtttttcaggaatgggaaggactgttccggctgatctgacaagagcgaagatctccatgtgtccatgtttctgcgcttcttttataaaagcctgtccgactcttcccgttgctccgagtaaagcgatgttcatgtaaaaaacctcctcgccgctcattatatcattcaaagcagcggggaaaagaatgcctgtgaataaacgggaaatggtgggcaacatattcattgaccaaagaaacacttacgaactgaaacagctcccaattgactgaggcaatgaatgacatgttttccctccttttttcctagggtatgtgaaataggaaaaaagggtgacggcataaaagaagacgcggtatcccgcgccttctgtaagccatttattgagttattgtacgccttggccgcccatgttctgctgtgcgaaagatactaaacgtttcgtgatttctcctccgacagaaccgtttgcacgagaagttgtttctccgccaaggtttacgccgaactcagaagcaatttcgtatttcatttggtcgattgcttgagcagcgccgggtactaatagttggtttgaagagttgttgtttgccatttgtatgatctcctttattaagtagtatggttgggtttgctggaattgcaccagccgatgattttcggaatgaaaaccattgccagctcggcttcacccaatgctgtttgccgctttgtactacgtattatggtgaatcaaacggcatctcattcggaaaaccgggtggtaaatagcggaagggaaaagaaaagcccagcctgatgcggctgagcttttagctttcagtcatatatgtgataaagcattaattcatgcagctcttttacgagagccggctcttcttttcccggatgtgtgtgtccccattcaatgtcaccggacttatggtaaatcccttcgtaatgcgtaccctgccagtaaaatgaaatccgccatccgggcagtttctcttttttgaataacggtttccagctgaagtgcgaaatcatgacgttcacgctccttgtaggaaatgttgatcttgttcattgtagctcatcattctgtgcctgtcccgggtaaaaccaaaaaaagacagcctcaccgccaaagtttttccggggcggtgatggaccgttctgataaataggacgcgtattcaaaatttctccgttttgtcaggtaatcgaccgatctcagcttcggatgggaaaaaatgctgcgcccggggcgggaattggcttcaaacatccaaactttccctgaatgatcgacgccgaggtcaaaaccgatttcgccgataaaaccttcaatgtgctcatttaacacgcggctgaccgccaaggcggcttttgaaagtttccgcatcatgccgactctctctcgcggatcgccgtataattcagctaacgtcctgacttctccgccggttgccagatgcgtcgtgatgctgttttcaccggaaatttttgccgcgatggccgtcactgtccatttcccctcggcgtttttattcgtgtgcaccctgaaatcgacggggcgtccatccagccggatcaggtcaatgccttgctgaattaaaaatgcggacgggtcattgttttctttaaatgatttcatgaaggatgccgcatctgaatactctgccgtcaccaccgttttttcctcattcgtgtgtttgacagataagccggcatctgttttttccaccctgtaaatccccgttccgagtgcgccgtctgcaggtttgatatagacggtgtcaaatgtgttgcataacgtctctaacgcttctgcattcgggtgcaggacagattttggcagaagtgaagcggtgaggctgtttttttccagaagcttatgaatgtcccatttattaaagaattgcggattaaaccacggaatctgatagtcattcatcagcctctgttttgtctgctgtaaaagcggaactccttccgtttttcggctcgggagcctgtcatatacgacattcggaagcgggacggccgtccgtttccagctgttttctttataaatcagcgcttggacggtgccttcttcccagttgatctgatgagccccgaaaacgaaacaatatccgttcgcctgttcatgaagtgagagcatcttggaaaagaaggctgtacggtctcttaacgggcgggacggcgatgatgtgaacccggctgtgaaaacgccgatcagcggtccgatgtgcaccgtctggccgtgtatgagaaagtcagcccggcttttatacggtatcaacagctcctcaaacaaatcttcagaaaggagcgcgcttttttcaagtgattgagaaaaggctacacggcatttgacaaccttggtcccgaaggcagcggataaaagcccttcccgtttcatggaggaggggagaaacagcgtatttttgctttttttatcgatgccgacaatcatccctttatgattcacgcggtaatactcctttcctgctttcctgtgactgaagttcgcggaagcgtctcagcggacccgtatacaaatcctctttcgcctccggagccacgcttaaaatagctttccgtcccggctttgaattgacatccaaaagccagatgcgtccgtctttggcataacaaatatcgagccccagctcaaacagcggtccgaaccgttcatcaaggaaataagggacggattgggtgatcgaaaagacatcatccaataaaacggcctgctgctttctcggaatttcctcaaaccatgtgtcaaacttaatcggttctgatcctccgggcaaatgagataaaagaccgttctgataaccccttctgaccgcttttccgaccgtttcccaaacgcctgactccgttttgcgcatgaaaatgcggatgtcgcacggatgccgttctttatcctggatatttaagtaggattgaagcaaatagcggtgctgcagcacttttttgcaccaagacttaaaagacacgtgattggaaaatgattttgtttgtttgttttttccgatatagtaagtggccgtaattgattttttgcctgtttcaagcaggatgatgcctctgcctcccgcgccgaaagcgggcttaagtatacatgctttttccttggctaagtatgattgcacctgttcatagcggctgacttcggccgtttcaggaatatagggactgatcaggtgatgcttttggagcgcatccgtgaccgtccatttatcaggaagcccccgcccgataaattccgttttcggatattttttcagccattcgacgatcggtttggctttttgcgcttcagcggattttccgtaaaaacagcggtcgtaaatatattcgggaatatcgatttccgtttcgttccactttctgctttgcgggtgatagacaagcgctttcacgcgcaaagaatccggaaatatatcaaacggtgtaaagcgggctaagcgcacattatattgaggcgctctttcagccaattccccggcgtaatcttcttcgtgccggcgggatacagacataaaaccgagtgttgtcatattattactccccctttattcaaaaagccgctgatggaacggcccttccatccaataaatatgctaagcgcatcataaaagatgatctactgtaaagagtacgaaacagcatcttgccttattcctcacaaacaacaattcaggttcttcatttgcccgcatgcccgccagcctctataatacgaatagatatatcatcaagaaaatagaacataagatggaggcagaagaaaaggaatgggcatagcaggaacgtttctatttatgattgtgatcggagccgcgatcggcgcggtgacgaatcatcttgccattcagatgttatttcgtccgtaccggccgtattacctgttcggaaaacgggttccgtttacgccggggctgatcccgaaaagacgggatgaattggcaaaacaaatggggctcatggtgacgaaccatcttttaaccccggaaggaataaaaaagcggcttttatcagataccgttaaaaaccaggcgcttcttttcgccgaacaattcacgcaaaaaatggccgcttccgagatgacggtgcacgaagctttggccgccgcgggcatccggaatccgcaggaaattacggatgcctggattgatcgttttaccgatgaaaagctttcggacctgtaccggaaatatgagcaccgcgccataaaagactggcttcctgatgagctgcaggaaaagctggatgaaaaaatcccgctggccgcagattatatcctgaagcggagcattgattattttgagagcgaagaagggaaagacaggctcggaaatatgattgacgactttttgaattcccgggggatgctcggcggcatggtgcagatgttcctcggcaattcaagattggcagaccgtgtgctgcctgagctgttaaagtttttgcgcaatgaggaaacgaaaaagcttctggctgatctgctttctcaagaatggggcaagctcaaatcttatacactttatgaggccgatgaaaagtggaatgcgaaagatctgctgttcagcatgaaaaagcgggctttggccgcacttcaaaccgcgccctttttcgaatgccggctcggtgacatcatctcccgttatgaaggggagattacggggacgtacgcgccgaagctgcttgatgcggcactcggcagtattgccgctcatttggaggatgtgctgaaacggctgcgtcttgaggaagtggtcaaagagcaggttgatcagtttcccgttgaacggctggaagaaatggtgctgtcgatttccaagagagaatttaagatgataacgtatttaggcggtctgctcggcgggataatcggagcaattcaggctttgtttgtcattcttttctaaggaaaacatacgccgatgatgaaagtcgctccgcagtctgttatagtggagtggtatgtccgaaaggaagaaaggagcggttactatggcagttcatttttatgatgcagcatatgatcttgaaaaagctttgcgaaacagtgatgaatacagccgtctgagagggctttatgatcaagtaaacgcagatgaatccgcaaaacgcatgtttgataacttccgcaatgtacagctgcagctgcagcagaagcagatgtcaggtgaagaaatcactcaggaagaggtagagcaggcacaaaaaaccgttgctctcgtacagcagcatgaattgatttctcagctgatggaagcggaacagcgcatgagcatgctgatcggcgagttaaacaaaatcattatgaaacctcttgaagagctttacggcagcccgcaataagctccacacccctccatctatgaaatggaggggtttttttattcaacagaaaaatcaagagaactttttaccgttccgttaatgatgacagacagagtgtgaattccccgataatgcttgcgggtggttaaatctttaagggaatgatgtttgctgaaggcttttacgtctccgttatccatggcggactccgacatcttaaacaccttgcggctgcggtgcccccttttctttacaaaatcaatcgcgtattcaaccctgactttttgccgggcggatgagcggatctgaaaagaaaaatgtatgcttgttccgatggcggccgtttccggattcagtgtaaaacgttccaatgaaatccgggaggcgtcttcaaacccgaaaatcgcaagcgcctgtttgtctcctctttttaacagtgtcctgcaggcgtgcttcaaaacccaatccgtgtgcggacagcttccgaaccgctcggctgcgatctgtgccagaacatccggatgtgttttggagatgtcattcaggttattcgccacgctttttctgacatataacgagtcatcctgcatcaagcggtccagaacagggagaatcggagaaggatcttcaagaagagccggaatggagcttccccacggcagtcgcggtcttgagccttcgctggcaagccttctgacatgttcgtccggatgctccgtccaggaaaggaactctttgaacatccgctcccggtcaagcctgatatacgggcggaccgcaaattcggaagtggaaaaacgagtgaaaaactgaagcgccttcattgattcttcccagtgatccgttccgtactgttggacataatcgggaaaaataatcccggcgagccctgtgaaatggggagctgtctcatataagacgtcaagcgcccgtatgtaatccttcggcagtgtttcatataaagagtctgtgatccggcgcatccgctgttttaacgtcagtccgggccaatcttcctgaaatatcagcgcccggcacttgtcccgctcaaaagccgggtacgccgatttgattctgttcagaagtgcttctgcaaattcttcgttataaatatcttttaatagagacatgacagtcaccgctttttttcttttattatatgcgaatatatgttctctttcaactttatcatacattcagcacagatatttcccctgatttttttagttaaaaaaacccttgttttttaacaatattattgagataataactctgaaagcgcctacacttacagatgatctaaggatacggtcgcctatactgcctggtatgttaaggggtagcaacagagagtaagtgaaacgagcgcatcaacggtcaaataaggggttcctgatatatttcgtaaatagaaatgcacattggggagaaggcagcaaatcgatcgtatcccaacaaaacgacagttcaaagtctgcttgaggcaggcttttttgctgcggagaaaaggttgttctaaacaaagagacagggtcatatcctaatgacaagtacagtcatcaaggagggggacttctctgtgtcaaaacaaatgctggcgttaaatatagacggagcgcttcttcgctccaacggcaaacttcatcagacgacaaaggatgccatcgaatacgtcaagaaaaaagggatttacgtcacactggtcacaaaccgccattttcgctccgctcaaaaagtggcgaaaatattaaagctgaatgcaaaattgattacccacagcggcgcatacatttctgaaaaaatagatgagccgttttttgaaaagaaaatatcagaagatcacacgtttaatatcgttcaggtgctggaaagctatcaatgcaatatccggcttcttcacgaaaaatattcgatcggaaacaagaagaaagtgaactccaatctggtcgggaaaacgatgattcatccgtctgatccgattttttatccggtgcagtttgtcgaatcattaagtgacctgctccttgatgagccggtttcagcgcccgtcattgaagtgcacgctgaagatggcctgcaggctgatataacggatacgataatgaaagcattcccggccgtcgatgtgatccgcgtcaacggagaaaaactgaacatcgtgcctaaaggggtttcaaaagaaagcggactttcgatggtcgccgctgatctcgggctttcaatggaagaggttgtagcgatcggccatcaggaagatgatctgccgatgatcgagctggccggtctcggcgtcgcgatggggaatgcctcaaatgaattaaaaagaaaagcggactgggtgacaaggtcaaatgatgaacagggagtcgcctatatgattaaggaatatttccgcatgcagcaccgcaaaggctttctcgataagttccatatgaaacggccgtaatcaagagccgcagacgcgaaacgccggtctgcggctttttcgcggattgattttagcctgttctttctgtacactaaagaaagttttgaatctgaaaaataaggtgatcacattgcaaataaaaatagacggcataacggatgacaggctgcatcgtccgctgcaaaacatcgcgaatttattttttgaagagtgtgttcttgcgtacggcgaaacggaggcatcctctgatctcgtcatctcacttgccatttctcaagatgcagacagcgtgtcggtatccggagaaatcaaaagaaccggcgaaaaggaacatcacacgaaaccgcttcttgccggatggagcgaaaaagaagtatttaaacaggtgaaaaacacgctgtcatatgtctacttaaatcttcttcaatcacatacgggcatgatacaaaaatggggaatcttaaccggcatcaggcctactaaacttcttcataaaaagctgcagagcggcctgacaaaagaagaggcgcatgccgatctgaaaaaagattatctgatccatgatgaaaaaatcaatctgatgcaggagattgtcgaccgccagctcgctgcggttcccgatctgtaccgggtcaaggatgaagtcagcatttatatcggcattccgttctgcccgacgaagtgcgcctactgcacgtttccggcttatgccattcaaggacaggcgggaagagtcggctcctttttatgggggcttcactatgaaatgcagaaaatcggagaatggctgaagcggcatgatatcaaagtgacgaccatttatttcggcggcggcacgccgacaagcattaccgctgaagaaatggatcttttatatgaagaaatggtccgctctttcccggatgtcgcgaatattagggagattaccgttgaagcgggccgtcccgacacgattacggaggaaaagctggccgttttaaataagtataagattgacagaatcagcatcaacccgcaatcttatgaaaacgaaacgctaaaggccatcggcagacaccatacagttgaagaaaccatcgaaaaataccatctttcccgcaaacacggcatgaataatatcaacatggacctgatcatcggcctgccgggagaagggacggctgagttcaggcacagtcttgaagaaacggaaaagctgatgcctgaatctttgaccgttcatacgctttcttttaaacgggcgtcagaaatgacgagaaacaagcataagtataaagttgccgacaggcaggaagtatcccgcatgatggatgacgccgtccgctggacaaaagagcacggctatacgccgtactacttgtaccggcagaaaaacattctcggaaacctagaaaatgtcggctactctttcccgggtcaggagagcatctacaacattatgattatggaagaagtgcagacgattatcggtatcggctgcggcgcggcaagcaaattcattcatccggaaaccggaaaaatcacgcacttcgccaatccgaaagacccgaaatcatataatgaccgattcgagcattatacagaagagaaaatcaaatacttagatgagatgttcgtcaaatctgcattataatatcaaaaacggcacggaatcagcgtgccgtttttttatgtttaaccgtctgtaaaaacgggaaaagatcatcagactgttattcgcaagaggtgcataatatgtatgatgtcataggagcgggaatcgggccgtttaatttagggcttgccgcattgttagaggatatacccggaacagacgctctttttttcgataaaaagaaagaatttgcgtggcatcccgggctattaattaaaggaacggatttacaggtggcgtttctggcagacctggtcacgctcgccgatccgaaaagccgctacacgtttttaaactttctccatgaacatgaccggctgtaccggttttatacgtttaatgaatttgatattccgagacgggaatttaacgactatttaagctgggcggcttcagaaatcaaatcatgccgtttcggctcagaggtaatcggtgtgaaaaatgccggcggacattatgaagtcagcgtcaagaacattgaggacggaagcatcagtgtctatcagacgaagcatttcgtcatggggacggggtctgaaccgcttattcccgcagagattgatgacggagcgcgtcaggacacgatggtcagcacggaatatttgtttcggaaagacgagctcgccggcgccgaatcaattacagtggtcggctccggacagagcgccgcggagatcttttctgacttattgcatgatgaacaataccgccgcagccggctgcaatgggtgacacgctccgccggatttcgagaattggaaaccgccaagctcgggcaggaaatgtttacacctgattatgtggaatattttaaccgcctgccttttaaagaacggctgaacacactccctgagctggacggactgcgccacggcattgattctgacacacttgccgccatttacgatgccctgtatcacagatcgatcagcggaggttcgcctgacgtgtatattcagccgatggcggagcttgaaaaaattgaaaagcaaaacgggcgctgcgtactgagctttcatcaatggcagatggatgaaacttttacggccgattcagaaaaagtgatattggcgaccggctttaaacctcatattccggaatggtttacggcaattgcccccgatatcgaatgggaggatgagaaacggtttaaagtgacggccgattcccgtcttgtctttaaggacgacaggcggcatcactttttcacattaacgaatcttgatcatgctcacggaacgggcgctacgaatttgaagctgtctgtttacagaaaccaaaaaatcatcaataccattctgggaaaagagcatttctccattaataaaaaaacggcttttcagcaatttcttcccgctcaaaaaaactgacctcttatgaagaggtcagttttttttatgatttctgcggcttcttttcaggcgtcttccatttgaacacgctgttcagcaggagatatatccgcttcgattctttcgtgagcaaagggccgaagatggccagtatcaaaacatataaggcggcgaaaggtttaagtgaagcggacaggccgccggcgatgccgagatttgcgacgataatggagaattcgccgcgggacacaatggtcagcccgatattggacgatgctttatgagaaagccccgcccggcgcccggcgatcatgccggcgataaagtttccggcaatcgtcagcagaacggcgccgagggcaagccataccgcatctccgagtgaaaacggatcaatgctgaggccgaagctgaagaaaaacatggcgccgaaaaagtcacggaacggcacgacaagatgctcaatcctgtcagaatgggccgtctccgaaaatacgagtccgagcaagagcgcgccgatcgcttcagcgacatgaatcgtttcggaaaagccggcaatgaaaaagagcgcggcgaaaatgacgatgacaaatacctcgtttgaacggatatcaagcagcttgttcagcagaggcggcaatttccgggcggcaatgaaaaacagcagcatatatccgaaagcgatcacgattgacatcagcgcgcccccgacagacgtcgcgtctcccagaacaagcccggaaacgacggacaagtaaaccgccagaaagatatcctcaaacataatgatgccgagaatcagctccgtttccggattggccgtgcgctttaagtcgacaagcacctttgcgacaatggcgcttgatgatatcgtgatgacgcccgccaatacaagcacttccaaaaaggaaaagcccgtgataaagccgtagatcagccctaaactgaaattaatcagaatataaatcgttcctccggcggcgattgaacgtccggatttgactaattttccgaccgagaattcaagcccgaggtaaaagaggaggaacaggacgcccatccgtccgaaaaactcaatcacttcccggctttcgataaacgtcaggtcaatgatgcccgcttggggcgcgtgcggcccgacaagcattcctaaaatgatcaggaaggggatgatcgagaatttaattttattggcgatgacactcgcaatggccacaagaactaacgccgtaccgacttcaaatacgagatgatccataaacagatcacactccgtctctggagaggaagtcttggatcagttttttcagatgctttctttcacctgagaggacgagtgtatcgtttgcttcaaggagcgaatcagcgcccgggtttaaaaactttttctggtcatgcttaatgatggcgataaccgtcacgtcatagttttggcgcacatccagttcgccgagcgtccgccctgctgcttttgcccctttttcaactttaaaccattcgataatcagatcgctgaacgccatttcaatcgattcaagcgcctgcggtttgtacaccatcccgccgataattgcggcaatctgtcttgcttccgcatcatcaagtgaaatgcttgccagaagctcatcagggtcgcggtcatcaaatctgtaaatttcccgcctgccgtcatcatgaatgatgatcgtcattttttcatgatttctcgtttcgatttcgaattttttcccgatgccgggcagatcgttttctttaatattcataaaaaatccctccggaatatactgtttttacaccgtaaatacagattggcaatgagaaatggtctgatgccggaggtaatttgactggtattgtatcggaatgacgcatgtcctttccattgtggaatcaatgaattgatcaagaggtttgacagataacagggagatcatccgcgataacgcaccgtatccttttgacaggccttgcggagcggttttggtttgaaccggcgtctttgccgattccgtttcctgcgggtaaaccgaaatttgtacatggctgtctgtttctgtcaccaattgggaaggaagagcgacatccgaaggggggaacagcaccataaaaaagctcagtaataagctgagtatcacatatttcattatcggtgtttttccccccttttgttttgtatatcaatttcactatataaaaatgtatgttcagtttcaaatgatatgcatttttcggcatctgttgaccttgaaaaataaaggagtttcgcttcgggggaaggaatatatcatttgaacaaaatatgtaagcggattcaaggagggagtaaacatgcagtatattcgttatgaagaaaaaggaaagatcgcagagattgtgctgaaccggcctgacaattacaacgcgctgaatgaacaaatgcttcgggaattggaaaatgcatgcgttatggcagccgacagtgaagcgcttatcgtcctcttgcggggggaaggcaggggattttccgcgggcggtgatatccagatgatgacgtctgatcatgattcaggagaatatgaacggctcatgaaaatgattgaatccattacgctgacgctctatgatatgaaaaaaattgtgatagccgccatccacggagccgcggcggggctcgggctgagtttcgcgctgtgcgccgatgtggtgctcgccgaagaaaacgcccgactcgcgatgaatttcatcggcatcggattggttcccgacggtggaggccactatttattaatgagacgcgtcggtgagatcgaagcgaaaaaactgatttggagcggtgaaaaattgccggctgaaaaagcggtgcggcttaagcttgccgacgggctgttcagcggcggccctgcggagggggcacaaccgtatatcgaccgattgctgcatgcgccgctgtcagcgatgattgaaacgaaggctatttatcaaagtctccatatcagccggttaaaagacgttttgtctcttgaacgaaaggcccaggaaaatatgagaaaaacggatgatcataaagagggcatccgcgcctttttagaaaaacggacgccgcaatttaaccggtaaaatacagaagccggaaagcttctgttatctgtggaataaaatcagctttccggcttcatttaccaagcggtgagtactgttctcaagctttttttcctttaacaaagcctctccggcggccttcgcctccgcctcattatctgcttcgatccgttcatccagcatcgtttctcccgacgcatggaatgcggtcaatacatattgtcccatcatgtcaccccctttatagaatgatattctgataaagaatttaaaatcctccattaatttttacccattattagtatataatgggtcaaggaaggagttggattcgtgcttacaattgaaaatgtaacgaaaacattcggcagctttaccgctgttgacaatttgaacctgcaaatacctgaaagggaaatgttcgggctgctcggcgcaaacggcgcgggaaaaacgacgacctttcggatgattttaggtcttttaagcctgactgacgggcatatcacctggaaagggaagccggtcaattattccatcagtgaaaaaatcggctatctcccggaagagcgggggctgtatccgaaagtgaaggtgagtgaccagcttgtctatctggcgagattaaaaggaatgagcaaaaaagaggcggaaaaagagctcatgacatggctcgagcggttcggcattacagattacaagaataagaaagtcgaagagctgtcaaaaggaaaccagcagaaaatccagttcatttcggccgtcctgcataagcctgaactgctgattctcgatgaacctttcagcggtcttgatccggtgaatgtcgagctgctgaaagaagcggttatttctttgaaaaacagcggcgtttccatcgttttttcaagccaccgaatggagcatgtggaagaactttgcgagaatttgtgcattctccagaagggaaaacccgtcgttcaaggcaatctgaaagacattaagcggtctttcggcaaaaaaaatgtcaccgttcattcagatgatgacctcagctttttaaaaacgcatgaaggtgtcgtgaaatggaaggaaacaaatgacggaatcagactgcaggttgcgaatgaaccggtttctcaggatattttccgggcgctgcaagggaaaggttttatacggaagttcgaattggaagagccgtcactgcatgatatttttatagaaaaggtgggggccgtatatgaataaattttggattatgctgtttcatacatataaaaacaaaatcgcgacaaagtcattcattatttcgaccgccattaccgttttattagtattagcggtgaccaacctgcaatcgattatttccgtgtttcaatcggatgacggcaagcagcaaatcgcggtgattgatgaaacgggcgggctgtacccggcgtttgcaaaacagcttaaagcggcggatacagacaatgatctgcaggcaatggagacgaaggagtccgaaaaagatgccgtaaagcgtgtcaaagacggtgaatgggacggactgtttatcatcagacaagatcaaaaaggaacgataacaggagcatacaaggcgctgaccatttccgatgaatcagcgtataaactgctcaagcaggctttaacccagacaaaaaccgctgtcgaaaccgccaagctcggcatttcggcagaaaaagtcagcagcctctacactccgccggaagtcagcaaagacgcgctggaaaaaggggcgaaatctgaggaagagctcggtcaggtaatggggcttgtatacatcatgctgtttgtcatctacttctcagttatcatgtacgcaagcatgattgcgatggaagtggcgacggaaaaatcgtcccgcgtcatggaaattttaatttcaagcatgccgccgattcagcagatgtttgccaaactgttcggtatcgcgctcgtggggatcacacagtttgcggtgctgattgcagcgggttatctctcactgaagctgaaccctcataatgatgcgtcgtcgccgatcagtgcatttctcaattttacggatgttcctgtctcgacgatagtctatgccgtcattttctatttgctcggctattttctttacgcgacgcttgccgcgtttctcggcagtgttgtcagccggatagaggacgtacagcagacgattcagccgatggtttttttagtcgcggcaggtttttttatcgccatgttcggacttggcaatcctgacgcgggttttattaccgttacatcttacattccgtttttcacgccgatgattatgtttttacgcgtcgggatgctcgatatcccgttttggcaggctgcggccggaatcgccctgacactggtcactatcgtgatctttgcggcggtcggcgcgaaaatttacaaaggcggcgttttgatttacggaaacgccagcggattcaaagcgatcaaacaagcgctgcgcatctccaaaaaataagtgaaacagcccgggacagccgggctgtttttttattttgcagaacgtgcattcgtataaaaacggtgctaaaataagggtaattcaatctgcagaaaggggagggcgagatggctgatctgacgtttattcatgccgctgacctgcatctggacagcccgttttacggcatttcgaatctgcctgaaccggtatatgcgcgtattaaagaaagcacatttcacagcgtccgccgtctgacggacggggcactccgggagcaggcagatttcgtgctgctttcgggggatctgtttgacgaagccaacagaagtttaaaagcccagctgtttttgagaaaacagtttacgagattacaggaagcgggtatccaagtgttcgtcatattcggcaaccatgatcatttgggcggtaagtggacgccgattgaatggccggaaaatgtacatatattcacctcgggtacaccggaggaaaagtctttctttaaaaacggagagcttgcggcaagcatatacggatgcagctatcaggaaagaagcgtaacggtcaatcaggcggcccgttaccggaaaatgaccggcgcgccttatcatatcggcatgctccacggcatgttatcaggagcggaagggcatgacccgtactgcccgtttacgaaagaagaccttgaaaaaagcggcatggattactgggcgctcggacacattcataaacggcaggttctgtccgcccagcatcccgccgctatttaccccgggaatattcaagcccggcatttaaaagaaaccgggcctaagggatattatctcgtccgggcggcaaacggtgagatgtcttgggaattcaaagaagcgcatgatgtgttatgggaggaaattgatcttgatatctccggagctgaacatatgacttcacttctgaaagccgcatcggatacattctccggcttgcgcgcggcgggccgcccggcatgtgtcaggctggtgcttcgcggcgcggcgccccgcttttggacggaggcgcccgcaggcatcgcagaggagtttctttccgctttacaggaggaagaggccgaagaggaatgtttcgtctggccgctcgcgcttgaggatcggacggatgatacagacagcgtgccgcccgatccgttttttaaagggctgcttcaggacatagaacaatgcgcagacatgagcggtgtatttgaagcccttgagcgtcaccccgtataccggcgtcagatcacttcatttacagatgaagagatactggatattaagcaacaggctcaagccgttttaagacgccagatgaaggagattcagcgatgaaaataacggcgatgcatatttaccaatacggaaaattttccgaccgaagttttcagctgtcagattctcccgtgcaagtgatctacggattaaatgaagcgggcaaaacgacattgatgtcctttatcaaaagcgtgctgttcggttttccgaaatcaaaaaaatacgaaccgaaaaacggcggggtttacggcggcactgtggaattgaagcatggcgatcacggtgccgtcaaaatcgaacggacaaaaggtgctgccgaaaaagtaagagtgtatacggcttcaggcgaaatcaaggacggagaatggctcaaacagcttctttccgatacagatcgggcgctgtacgaagcgatctattcgttcgatgtattcggactgcaggagattcaagcttttaaccgggacaaaatcggcgagtttctcctgtattcgagcttattcgggtcggaagcggcggcaaagcttgacgggcggctggcaaaagaacttgacaggatgtataagccgaacgggcggaacccccgcttaaatcaggagttggatacattaaagcggctcagcgcccagctgaaacaggcggaagctgcagaagcgggctatcacagccttctggaagagaaaaaaagcgccggcggccgtttgcaggatgccgaagcacgattgaaagacataactgaagaaatcaaaacagtaaaatcggcgatagaagcaaagccgatcgcagacaaaaaaacagccttggaaagcgaactttcttcttatccggaagcattgaagcaattcccgaaggacggaatgcatcagcttgaaaaatacgaatcgcatctccatccgaaagcggcccgtcttgaggggcttcgggcaaaagcggctgaactcaggcggcaggctgagctgctcgctccaaatgaggacttgctgcaaacagagcggcagctgcaggagctttccggcgagcagcatatgtacgaatcgcgcggtgaacagcttgccgccatccaatcacagatccggcagacatctgcccgtgtttcgtcaggattgcagcagctcggaagacatgaggaagacggcattctttcgctgaacaccgattatgaatatgaatggcggctgcaggaagccgtgcagagcgccggacaggcaagagaaagaaagacacagcttgatgcgattttcgaacaagcgcggctggagctggaagaagccgaacgaaaacatgccttgacggcggaaaacattttggaccccgctgtcaggaaagaaaaagaagccgctttacaatcatataagcaaacagctgatacagaaggaaacgaatggcaggcacatgtacagcagctggaaaaacagcgcgccaaacaaaaaaagctctttctcggtgcgggcattctgttcattgcgattttcgctatgttaaaggaatggctgcccgccgccctttttaccggcgctctgctgctgtatatgctgtccggcatacaaaagccgctgccgtcagaaagaggagggcccggacacaagaaaaagaagccgacgatctccaaagaagcggctgatcttctgcaggaagagctttggcgtgacggccggcaccggcagcagctgattgcggatcaagccgtgcttgaacagaaagaaacggcatatgaaagagtcatccgccaatatgaagaatgggaggcggaaatggcgccgtctgaaaaacaggcggaactttttatgaaggaactggggttttcaggaagtccttcccatcttcttgacgcatatcatgtgatgaaagatgtcaaaaaagaaatccttaacaagcatgagctgaccattgaagcgggccggctgcaaaagctgcaaagagcatttgaggaccgggtcaaaaagctgagtccttcagacggaagggagctgtccgtaaaagaaagactgcgcgttttgctggtacaggcggaacgagcccgtgaggaagcaaaacgaaagcaggcgctcgaaacggatctgctgcatgcacaagagcaaatgcgtgaattaaacgaagaagtccattactacgaacagcaggtcaaacagcttttcatggcggcaggcgcaaaaaaccgcgaacacttttgtgaactcgccaggctgaatgaaagccgccgggaaacagagcggcagctgcgcgaaatcaaaacgcacttgtccggcataggcggaaaacagcttgagccatttatgagccgcacagtgtccgaacttgaacatacagtcgttcagaaggaaacagagaaaaaaacgcttgaggaaaaaagcgcgcagctccgtgagaaaaccgctttattaacggtgaaacaagagcagctggagtcctcggggcttgtatccgatttaaaacagcagacagaaatgcagaaggagcgtgtgaaaaaaaccgctaaagagtgggccgcattacagacggtcagacacatcatcagggaaaaaatggagcggcataaaaaagtgacgcttccccgtctgttagaaaccgccggtgcattatacggaccgcttacggacggacgctaccacaaattgtatttctccgaggcggatgattccattatggtcatgcggaaagacggaacggtgttttctgcaggcgaactctcacaggcggcatgcgagcagctttatgcggcgatccgtttcgcccttgcgtcagagagggaatctgcggtatcacttccgtttttacttgatgacagttttgtccattttgacaggcagcggctggagcggctgtttgatgtgctgaatcagctttcagaaggcgggcggcagatactttatttcacctgccatgagcatgtcagccggtcttttcacagcggacaagtcatgcggctcctgtcataaaagagtttattttcaaaaaagaggtatgtgctatactggtattatgtaagatatggagggagcttttaatagaatggcaaaaggtattatgctgcacgaggtcggcgagcaggtcgatcaatactttctgattaaatcttcgactaagggaatcgcaagcaacgggaaaccattcctgacgttaatgctgcaggaccaatcgggagatatcgaagcgaagctgtgggatgccaagccgactgatgaagtaacgtacgcggcgcagacgatcgtgaaggtgatcggagatgtccatcactatcgcggacgaaaccagcttaagctgagaaacatccggccggccggcgagaacgaaaatgtcagcattgatgattttctggaaacggcgccgattccgaaaaatgaaatgatggaaaccgtcactcaatacatttttgaaatgaaaaatccaaatatccagcggatcacaagacatctggtcaaaaaatatgcggctgagtttatggattacccggcggcggctaaaaaccaccatgagttcgtctccgggctcgcgtatcatgtagtgtccatgctgaacctggcaaaagcgattgccgatctgtatccgtctcttgaccgggatttactgtatgccggagtcattctgcatgatctcggcaaagtaaaagagctttcaggccccgtctccacgacgtacaccgtggaagggaatctgctcgggcacatttcgatcatggtgacagagctttcaaaagcggccgaagagcttcagattgacgctgaagaagtgctgattctgaagcatttgattttaagccatcacggaaaagcggaatggggaagcccgaaaccgccgatggtgaaagaagcggaaattctgcactacattgacaatctggatgcaaaaatgatcatgatggacagagcgctggaacgggtgaagccgggcgaatacacagagcgtgtatttgcgcttgaaaaccgttctttctacaaaccgacgttccatcaataagataaaaaggccgattctctatgatcggtcttttttacgttcagctctcataacttgtctttatcaagcatagcttagaataaagactctgggtgaaaaagggaggaaaccgacgtgctattttttccttggtgggtatacctttgcattatcggaattattttcagcgcctataagcttttcacaacagctaaagaagaggaaaagcttgaccagtcgtttattgaaaaagaaggaagggtgtatattgaacggatggaacaggaacgcgagcgccgtatggcggcgcccgcaagtgaaaacgcggatgcggaagaaaactccaatcattccatcgcataaaaaaactgtgcggctcgccgagagcccgcacaatttttttatttagattcagaagaagttgaagtgttaaacgtgtcttttaagtctttgtcttccacttttacgtcagcttttttcatgactttttgaattgccgcctgtacagctgagttgtcgtttaatttctgtttaagaacttcttctttcagttcttttttcatgtcatcatatttgccgcgttcttctgtctttttgatgatatgataaccgaattttgttttgaccggatcgctgacttgtccgactttcagaccgaatgcagctttgctgaatgtttcatccattgactttttatcgaaccagccaaggtcgccgccgttgtcttttgagttgtcagttgaatattctttcgcaagcgtttcaaacttctcgccttttttcagctttttctccacttcgtcagctgtctttttgtcagcgacaaggatgtggctcgcacggattttaccttttaagccgtcgtaatattctttcgtatcagcgtcagtcactttgatgttgtctttcgccgctttttgtgcaagcagttcgtacttcacctgatctttcaggtaatcttcgccgtactgctgtttaagggcgctgtactgatcgccgagctgcgttttgtactctttcagcttgttatcgatttctttatccgatactttgtatttttttgctaatactttttcttgtacgagctgtgtcagcacacttgcgcccgcggtttttttcatattcgtgtagagctcgccttttgttacatttccggcatccgtcttggcaatcacgtcgttgtcgccgctgctgcaagcgctgagagccaggacgctcgttgccgtaatagctgctatcgcgattttcttcattcctttaaacactcctaatcatccaaattaaattgcatatgcgtatcataacatattgtggctttctgtaaaaagattttaaataaagggcattcgtctagtcaaactttttcctgatacatacaaatatattgatcatgaaaaggaggtaatgaaccatgggcggaggatattcaaacggtttcgcactgctcgtagtactgttcatattgcttatcatcgtaggtgcagcttacatttgttaagcgaaacggatcgctttttctaaaagcggtccgttttcttacccgggcgcctaatcgtttcagaagtaaattgcatatgatgtaattggaaaaataaaacgttttgtaggaggtgcttttggagatgggtgaagtatttgcaggcggttttgcattattggttgttctgttcatcttattgatcatcatcggcgcttcttggctttattaagaaaaaaatatggctgtcgggggtcagacctccgtcagccatatttttttgcctgtttacacagtaaaggagatctcgacgaatgaagagatcagtaaaattaaaatagatacattaataaaacggaataccttatcctgccggtcttcaggaatctctctgacaaggcataatgtatttgtgagcctgtttatgaaataaagaataaacagggcagccacgataaaatagaataaaatgatgggagattccccctctctctgaactgctcccatattacattaccaaatatttattaaaaaagatagaatgtaacctgaaaaatcagcgggatatcaagactccggcactttttttactaatatatcaaaaccgtcggattcctggtcaatcagacatgatttgggcgctttgaccaggtgcagcgcaaacagaagatcaggcaggcaataacccgcatgaatgctcgaaatcatataaaagtaatgagcgtgtctcggaaatgccagtccggcataaaacaataacggcgtaatgaataaaaacgggctgatcgtagaaatcagcatcgtcgttttcggtatgcctttccaagtcggcatccgcaagaagtacattttcatttccttttttctttttttacagatcatcggcaggacatgtatgactttatgtacaaataaagtaacaacgagcagaacacaaaaagcaaacacgtgcccgtcacttaaactgatattcggacgcagcagcccgaatgccaagaagttgcatataaaaaacaggatcataaaacctacagcagtcaataataaacgaaccgcaccataatctttgatcagattaatggttttccagcaattcatcagagtcatccttccgtacaaagatggaatacaatctcaaaataatttactctcttcaggagaaaaaatcaatccttttttaaagaaaaaaaataaccccggaaagggaagaacagaagagctcggtgaaacatggaaatgtacggtttaacctttcttctctattcattatcagctaaaataagattaaagatagaaagaagtgaaacggatggattcaatggatcagcgtatcgggcgtttagaatattacatacaattgctggtgaaaacggtggatatggataagtaccctttttatgcgatgatgattgaaaaagggctgaccgaagaagaaggagaagaggtcgggcggatctgccgcgaattggaggacgagctgaagtcgcaaaaagcgcaaggctttgtgacgtttgacaagctccttgcgctttttgcgggacagctgaacgaaaaattagatgttcatgaaacgatttttgctctgtatgagcaggggctttatacagcgctgatggaagaatttattgagattatgaagcactttgattaactgttgatcggttccagctcttcagccgttttatggacagccgattcgtccgtttttttcttcagccttccgtcttcactatcaaaatcattgtttatgtttgtcaatgatttctcgaatatctccataaaatcctcgccgtaaatgtggcggatgacacaggttaattcttcaacttccggaaacttcccgaataagtggtagatcggctgtgagcctttaaacaccgcgtttctcgacgggtcaaactcctcaagcaggctttcgaatacattttccccttcttctgttaactgaatgtacgtgttccgtttatcattcagccgcttggaaaatttcagatatccccgttcttcaagcttttttgaaaagttaaatgcagttgatacgtgcataacgccgaatttggcgatttctgaaatagaagctcctttaagctgataggcaatccataatatatgatgctcattaatattaaggtcgtacggcttcagccaattctgccagtctttctcgatagatttccagagcgctttggacagctgcgccattttttgggtatagattaaagcttcttttagatcgtaaggcggttcaacacgattcaatacagatcacctgcttcacattttcttttcctctattatgccaataaaataaagattaataaagatgaaaatttaagaattttataataaattcttcatccgttgctgggaaaggctttaaaccgcaaaaaaaagtgcggaacgcaatatgtccgcactttttttggttgtataggatattagttttgtaaggttttctccagctgtctgattttctcttcaatatcagcgatttccttttggagatcctgctggtgcggcttgatttcctcctgccaccttttaatgctggtctgaagctctccgcctacgtctttaatgacttctgcactttctttcgccgtttggacaagctggtccttaagcgccattccgtctttttttaaccgtttgattgtgtcctcaattgaattgcaatttgctttgattttgccccgcagctcttttccggatgaaggagccgaaagtaacaccgctgcgcctccgatcaatccgcctacgaaaaggcctgttaaaagggaacgtccgtcagccatttgaaatcaccccgttttttttctcataacttttatcatttttgttcagaagaataaacttctatacatagcttgctttattttagcatattttttaagggaaaaggagggagaaggttgtctgtctttatgattgttttatcttgtatggctcttgtctttgcggcgggcgccgtttattacctgaaactgctcggccaggccgcttcttatccgccgaagcgggtcgtccgccaaaaggccatcgtctgctcagcaggaaccgccctcacattgttccttatctttttcacaaaacttctcgtataaaacatgctgaaacacattaaaaaacctcttccggccggaagaggtttcggtatgcggttatttcaccgtttcaatcatattggaccgttttaagatcgtctgcacaatcggatgcataatgataatggcgatcgcattcagcgcagccgccggaaggacgaccgcgagcaccaaggcggtgaatccgcccggcaggccgacaatcagaagggccagcgccaaaaagagcaaaccggagatgaaggtgccggctattgtaatgacggcggcggccgctgttttcacgctctttttcactaaaagcaccagcgcgagaaacagaaacgccgttaccggtttttcaatgatattcggaagctgtccgcccggaaaagatgtcgtgagtgcggaaataattcccgttacaatcccgatcatcagcacgttctgcacacgggggaataacagaatacccataaacatcatcacaagcatcatatcgggcttcattccgaataataccggcggcataatggaatgaagcaccgctccgattgccgcaaacagggccataatgactaattcttttgttttcatactaagctctcctctgctaagctttttcgccatccaataatatgctcgtcatttattgcgatggccggaaaaattgatatgcaaacagtatatcaaaggaaccgttatgttagaagaaatttattcgttttcctgctggaactttttcataaactgagccagtttttcacaatcagccaggctgacggcgttgtagatagacgccctgcatcctccgactgagcggtggcctccgagtccggtcattttagccgctttcgcttcttcaacgaattttttcgtgagactgctgtcgcggagggtgaatgtgacgttcatgtgagaacggctgtcttttgcggcatgccccgcgtaaaacccgccgcttgcgtcgattgtgccgtacaggacgtcggccttttcctgattgcgccgttcagccgcttcgacacctccgttttcagccagccattcaaggacgaggctcagcatataaatcgcaaatgtaggcggcgtattatacagtgaatcggcttttgtatgtgtggagtatttcaaaattttagggacgttggcgttttcgttttcaagccatgattttttcatgatgacgaccgtgacgccggacggaccgaggtttttctgggcgccgccatagatgacatcaaacgttttgacatcaatttttctgctcaggatgtcgcttgacatgtcggctacgagcgggatcggtgaattcgggaactctttccactgcgttccgaaaatcgtgttgttggacgtaatatgcaggtaggcgccgtctttgattcctgtgaggtccgcttccggtatgtggttatggtttgaatctgcgcttgttgccgtgacggatgtgtttccgaacagtttcgcctcggcgagcgctttttcagaccatgcgcccgttacgacgaagtgcgccgtttgctgcgacgttaaaaagttcatcggcagcatggagaattgaaggcttgcgccgccttgaagaaataaaatatcataatcgtcgggaatatccatcagttctttcagaaggctttttgctttttgatgcaccgcatcatattctttgctccggtgggacagctccatgacggacatgccggtgtcattgaagttgacaaattctttctgtgctttttgcagcacatccagtggaagggctgcgggtcctgcattgaaattcgttgtacgttccatgtttacgatctctccctgttttccgctttagtgtaagaaataatacaattatcctatcacaattttttgatttttttgatatgaaaaaatataattttatgttttttgtgtttccggacgcaaaaaaacctcatctttaagatgaggcaagccgttttctgacggttgaagcgatctcctgaagatcgtcaggcgtatagtcttcggcgtgtgtcttccagacagccccgaaaccgtcgccttttccgtaacgcggaatgatatgcatgtgaaaatggaacaccgattggcccgctttttcaccgttgttattgagaatattcagcccgatcggctcgaattcatcgcggatggcgcgtgcaactttcggcaccgcttcgaaatattctttagaaagctcaggcgtaaactcgtacacgttttcaatatgtgttttcgggatcacgagcgtatggccttttgtgacctggctgatatcaagaaacgccacaacatgttcattttcgtatacttttgaagacggaatgtcaccggcaatgattttgcagaaaatacaatcgtccgctttgtgcatagatgggtttcctccctgaaaagaaatatatgtatattctcatcgtaccacaaaaacggccaaaacaaaaaacagggtgaacggctgcgcgttcaccctgatgcagaagtacgagctttatcacagaaaattaaatatgccttttgtaagcacctcatttgtttttaaaatgaagacttatgggtctgcttaatcattcctgggacaaacacctcatttgattatttcatcatgaatgaagaacatcatcaaagcagtgtgtgaagaaattgtaagcacaggacatgttgattttcatccaactgttctaagacgtcttttataaacacctcattttcagttgattaaagctgtttccttctacatacatatgatgtccgccaaaacgataactatgcacgcttttcacgtgagaaaaaaagggaatcgtttcaaatcagactttatttttggtactatgaagaaaaacgaatcagaaggggagaaattatgtctctgctatcggtaaaagacttaaccggcggttatacgagaaacccggtcttaaaaaatgtttcattcacccttgagccgaaccagattgtcggactcatcggattaaacggcgcgggcaaaagcacgacgatccggcatattatcggattaatggacccgcataaaggctcgatcgagctgaacggcaagacgttttcggaggataaggaaagctaccgctcgcaatttacgtacatccccgaaacgccgatgctgtatgaagaactgacgctcaaagagcatctggagctgacggccatggcgtacggcctttccaaagaaacgcttgaaaaaaggcttcctccgcttctgaaagaattcagaatggaaaaaaggctgaaatggtttcccgctcacttttccaaagggatgaagcagaaggtcatgatcatgtgcgcgtttctcgcggagccttcgctttatatcattgacgagccgttcctcggccttgacccgctggcgatcaatgcattgctggagcggatggacgccgcgaaaaaagccggatcaagcgtgctgatgtcaacccatatcctggctacggcagagcgctactgtgatgctttcattattttacataacggcgaagtgcgggcaagcggcacactggaagaactgagagagcagttcggcatgaaagacgcagctcttgatgacttgtatattgaactgacgaaggaagacgccggccatgaataatatgtctactatttggcagtcccggcttgaagagcatataaaggaaaccagaatgtatatgaaatatatgctcaatgatcatctcgtcattgtgctgatcttttttattgccggcgcggcgagctggtacagcaagtgggtcaaagacattcccgttcattttccctcattttgggtgatggcggtgctcttttcatttgtgctgaccggttcatacgtccggacactgttaaaggaagcggacctcgtgtttctgctgccgcttgaaccgaaaatggggacatactttaagcattcatttaagtacagctatctgtcacagctgtttccgcttattgctctgtcgcttgtatgcatgcctctgtttttcgctgtaagtccgggggcgtcgcttgcgtcgtatgccgcagtatttattcagatgctggcggtaaaagcgtggaatcaggccatggagtggcggatgacgtttatgaatgacagaagcatgaaaatgatggatgcggtcatacgctttatctgcaatatgctgcttttatacttcgtcttacagtcgttttatgtgtacgctgccgccgtctacattgtgatggccggcctttatgtgtatttcacatcggccgcaaaacataaatcattaaaatgggaagctcatattgaatatgaattaagaaggaagcagcggttttacagaatcgccaatctgtttaccgatgtgcctcacctgaaaaaacaggcaaaacgccgggcgtatctcgactttttgctcagaatgattccgtttgagcagcggaaaacgttctcctatatgtatgcgcgggcctttctgcgttcaaatgattatctcggcattcaggtcaggctcacgattatttttatcctgattattatgctcgtttccgccaatccgtggatcacggcggcgttaaccgtatttaccgtctttattacgggaatacagcttcttccgctgttcgggcattttcatcatctttctctgcaggagctttacccggtcaatcagaaagcgaagctgcaaagtttcttttcgctgatgaaatcagcattaaccgtgcaggcgctgctgttctgtgcagcgtcagcctatgccgcgggagtcagcggggcgctgtatgcggccgttgcttcagccgttctgatttttgtgatcatgccttcgtatatgggcggaagattgaaaaagtacggcaagctgtaatcaatcgggtttttgaaacctcaatgaaagaaggagacacagatgaccgacgatcagcagctgatacaggaagcactgcaatggaaagcgcgttttttgcgcaaggattctatgcttgaacgcttttctaaaggaatgcaggcgaaaataaatgagcggattcccgataaaattcatgccgtcatcacagaaagcattaaaaaaatgaccgaagcaacaatgacgggttcaaatctggtgaaaagcaagcgggatacaaacggtatgacgcttgctgaaaaagatgccctcgccagacaaaccatcgcatcgtaccaaaaggtcgcggcagccgaaggtatcggtacgggggccggcggaatttttttagggatggctgattttcctttgctgctatccattaaaatgaaatgtctgttcgatcttgcctccatttacggctatgatgtgaaagacagggatgagcgattgttcttgctgtttatttttcagctggctttctcaagcggtgaacagcggaaacgcatatactcaatgattgaacagtgggattcgaaaaagcatgatgtcgattggagagtttttcagcaggaataccgcgattatctggacgtggtgaaattgtttcagcttttgccggtcgtcggagccgccgtgggcggagcggccaattataaactgctgtcacagctcggtgagacggcaaggcacgtttttcatttaagaatcacaacagccggtacgtaatgtaccggctgttttttatgtcagcgggggtagcttaccgcggcgccgataagcaccttggcggccgtcagcatcgctttttcattaaaatcaaatttcgggtggtgatgaggataaatggtttccgcattttctaaagcggcgcccgtaaagaaaaaagcgccttttgtatgctgcagataataggaaaaatcctctcccgccatttgcggctctccttcaacgactttcgtaacgccgtctgtttccgctgcggctgccgccgcgtgcgccgcttcctcaggatgattgacgacggcgggatagccgcgtttgaaacgatattcataggaagcggagtgcatggagcagattccttttacgacggcttctatttctgcttcgagcaggctgcgcacactttcgtcaaatgagcggacggtgcctgatatgactgcctgatcggcaatcgcattaaacggattttcagcggtgaacgagccggctgagatgacggccggctgcaccggatttacccgccggctgacgatatgctgaagagccgtgacgatttgtgagccgattaaaacggcgtctttcgtatcgtgagggatcgcaccgtggccgcctttgccgatgactttaatcgtaaaaccgtcagcggcggccattactgggcccgggcggcataagaccgttccgacgggttcagtcgcccataggtgtgtgccgaaaatggcatcgacatgttcgaggcagccgtcctcaatcattgcttttgctccgccgggagataattcctcagcgtgctggtggatcatcacaaatgaccctttcagtttttcccggttgcggtacagcacttttccggccgcgaggagagccgccgtatggccgtcatgcccgcaggcgtgcatgacgccgggaatttgtgaagcatagggcacatctttttcatcctgtatcggcaaagcgtcaaaatcagctctgagtgccacgaccggtcccggttcactgccttcaatacaggctgtgacaccgttgcccccgacattcgtccggatagggacgccgagcttttcataaaatgaggcgatgaacgccggtgtttttttctccttaaaggatggctcgggattcatgtgaaggtgacgcctgatttcaaccatttcctcatacagcccgtcaagctgagcgtttaagcttttttgaagtgtcgttaacgtcaaaagcgatgccccctcgtctgcttttcccatgattgtatagaaaatatcagaagatttcaatctttttgctacgggagaatgatgatggcggcgatcgtcgtgacgataagtccggccgcaaccgggataaagtttttcctggcaagctcaaacgggtcaactttacaaatagccgcagcgggaatcagtgcccaagggaccaatgttccgcccccgacccagatcgctgaaatctggcccagcgccgttaaaacggccgggtccgtatgaagcgcggcagaaaacagctttgccatcgagcctgcaagagatataccggaaaacccagacccgtcgagcccggtaatcgcacccactgcggccagtgcgatgccggcgaattctccggacatcggaaaagaatgggacagggccagtccaaggtcattgacgatccccgcagaccctttcggcagcggggtgttcaaaatatttttaaaccccgcgtcaccgagataaaagaaggccgcgatcggaatgacggggccgaatactttaaagccgaattgaaaaccgccgataaaatactcggtgatcttttctaaatgccgctctttatatacaatgaaatgaatgatcaggagaatgccgatcgcggttcctccgacgagtgccgtcgcatcgtttccttggaggcggtatacgatcatgcagataatatcggcgagaaaaacaagcggaatgaaaaccgccaggatcaccctgagttttttcggcagatacatacttgtgtccaaagaaccagagctgtccaaggagagggggccttcgttttttttcgatcccgcatgatgaggaagaaagcggtgattgtcgtcgttaaccccatgatcaaaacgagcggaatacttgcctgcatgacatcgctcacgggaatgcccgcggcgtcggccgttaatttcggggccgcctgaatgacgtaatcgcccgataaagcgaatccgtggccgaacaggttcatcgccatagccgcggcgatcggagaaaggcccgcccggatcgctgcgggaagcagcacagcgccgatcagcgccaccccgggtgacggccagaaaaaaagagagatggcaaacatcagacagccgataacccaatacgcgacagccggccctttcatcagctttgcaaacggagaaatcatcgcttcattaataccggtttcggtcaaaaggccgctcatcgccacgataaaacaaatgatgaaaatcgtcggcagcaattctccggcggcatacgtaaagctgtgaaacaggctgctgaccgaagcggagaatgaatgcgtcgtccatagcgcaatcacaaaaatgccggcgagtgaaataaaggttgtatcttttctgagaagcataaaaacgataatggccgcgataaaagcaacataaagcagatgtaccgagtagacgccgatccccaattgaaccactccgtttataaataggattgctacagggtattcataggcgggcggaaggtgcaaagaaggatgcgtaaaatcgggacatcaaaaaagccggagaatctccggcggttttcagtctattgcgtaataagcggttacataagacggacgggaaaaaatagacgtcgtgtcgataccggcagatgttccgcgttttttatgagcttcctgataagagtttgactgctgccaatcctgaaaggctttttcctcttcccacagggtcaaaatgacatacgtatcgccttcgagcggtcttaatacgcggatggctttaaaaccgggttcattttccactttgccggcgcggtttttaaaccggttttcaaacagcggacggccttcctgggtaacggcgatgttgttgaggacggcgtagcccggatttttgatttccccgacgctgtcgatgctttcataggaatggggcgcctgaaaaacggtttctccatttgtttcatgaattaaaaccgcattatcctccccttgcatcagcaccatattctcactcgggtgtttcttggcaatcgtctttaaaaaatcggctgtcccgtatgtaatataaaccttcatatcagccacctcctgcttgctagtatatcaaaagagtggtataagtttctattggcgactcattctgacataattcgaaacaatatttcccatactacaagttaagaaaggcgaggtgacttatgctgaaaaagaaaaaaagattctttattccggctgtaattgcggcggcaaccgcttttctcgcgttaatcggatacattatcattatatttctcggccattatgtcatcgatgaaaagaaattaatactgcatgcatcttcaaaaatcgtcgatcaaaacggtgatgaaatcgcgagcctctatacggaaaatcgcgagccggtatccattcagcaggttccggaagatgtgagagatgcctttatcgccgttgaagataaacggttttacgaacatcacggcattgatgtgaagtctgtcggccgggcggtgttccgggacgttttagcaggcggcaaggtggagggcggaagcacgatcacccagcagctggcgaaaaacatttttctgactcatgataaaacatttttgcgcaagacgaaggaagtcattatcgccatcaatcttgagcgtgattacagcaaggacaagctgcttgaaatgtacctgaaccagctttatttcggccatggcgtttacggcattcaagccgcgtcccactactactttaataaagaagtaaaagatttaaccgttgcagaaggagccgttctggcagcgattccgaaggcgccatctctttattcgccgattcagcatccggataaaaataaagaacgccgcgatacgattcttgcaatgatgaacgatcaaggctatatcagcgccaaggaagccgtcagagcccagggccggacattggggcttaatgtcaagaaaacatcagaaacgccttggtttgacagttatatcgatcttgtcatcaaggaggcggaagaccgttattcgatgtcaggagaacagctgcttcaaggcggctatacgatccggacgtcacttgattccaagctgcagaaaacggcatataccctcatgaaggaaagcggctattttccggggacggatcaggcggcagagggaagcgccgtctttattgataataaaaccggaggcgtgcgcgcggcggtcggcgggcgcgactatgtggcaaaaggatacaacagggttacggcgaagcggcagccgggctcaacgtttaagccgattgccgtatacgggcccgccatgcaggaagacaagttcaaaccgtattcgcttctccaagacaaactgacgtcctacgacgggtatgaaccgaaaaattatgacggacagtacaagggggaagtgacgatgcaggatgcgatcacttacagcataaatgcgcccgctgtctggacattgaagcagatcggcgtggatacgggaaaatcgtatcttgagaaaaacggcatgaacatttctgacaacggactcgcgattgcgctgggcggtctgtctgaaggcgtcactccgcttcagcttgccggagcttatcatacctttgcggcaaacggaatgtatacgaagccattttttatagagaacatcacggacgaagacggagaaacgttatccgggcctaaaaacggcaaaacgcgcgtcttcagcggacagacggcatggaatatgacgagaatgcttcagcaggttgtaaaagaaggaaccgcttcacaaggcagctatcaaggtgacctggcggggaaaaccggcacgaccacatttaccggcatccccggcgcgacaaaggacgcctggtttgcgggatacactcccggactgacgggagccgtctggatgggctatgacaaaacggataaaacccattacctgaaaggcggcagccaatacccggtcagactctttaaagatatcgtcacaaaagcgggtgaaaacggccggacattcaaaaagcctgaaaatgtgaaggaactgggcagcccgattgagctggaggcggtaaaatccctgtcggcccgttatacatttaaggcgatgggactgattacggttcaattaaaatgggatattcaaaaggatgatcgggttgtttaccgaatatatgagaagaaagacggaaaagacaagcttctggattcggtgaaaggaaaaggcagctttgacataccgtacgccaatctgttttcaggggcttcatacaaagtcgttccatataattcacagacgaatcaagaaggagagggaacggaatacgttcagccgaagcttttttcttcttaatcatgaattcggcgattttttgaacattaagcctcaattctataccattcagaaaaaacaaggtatagtgtaatgggcgaagaacacgaacgtatggttgcaggaggaaaggtggaaattcagatgagtaaacgagaagcgtttaatgatacgtttttaaaagcggcacggggagaaaaaacaaatcacgtccctgtctggtacatgagacaggcggggaggtctcagccggaataccgcaagctgaaagaaaaatacggcttagtcgaaattacgcatcagcccgagctgtgcgcgtatgtgacgaggctcccggtcgagcagtacggagtggacgctgccattttatataaagatattatgacgcctcttccttatatcggagtggatgttgaaataaaaaacggaatcggcccggtgatcgatcagccggtgcgctctgctgcggatattgaaaagctcggcgaactgaatcccgaacaggatgttccttacgtgctggaaacgatccgattactcgtaaacgaacagctgaatgttccgctcatcggtttttcgggagcgccttttacgctggccagttatatgattgaaggcgggccttctaaaaattacaacaaaacaaaagcgtttatgcacagtatgccgcaagcgtggcaaatgctgatggacaagctcgcggacatgattatcgtttatgtaaaagcgcagattaatgccggcgcaaaagccattcagatttttgattcatgggtcggcgcgctgaaccgcgaagattaccggcagtttataaaaccggtgatggacagaatattccgggagctttcagcagagcaagttccgctgatcatgttcggcgtaggcgcaagccacctggccggggattggcatgaccttcctcttgatgtcgtcggtcttgattggagactcggcatagatgacgccagaaaacaaggcattacaaaaacggttcagggcaatcttgatccgtcgcttcttcttgcgccttgggaagtcatcgagaaaaaagcgaaagcgatacttgatcaaggcatgaaaacggacgggtttattttcaatttagggcacggcgtattccctgatgtcaatccggcaacgctgaaaaagctgacggcgtttgtacatgaatactccgcggcccaaaaaacggaacaatcttcctgagcagatcgttggttataagaagattttcctgtcaaaatcaagatagacagaccatcaaaagaggtgtttaactaaatgagcagcaaaaagaaaatgggacttctcgtcatggcttacggaacgccttacaaagaagaagacatagaacgttattatacacatatcagacgcggaagaaagcctgagccgcacatgcttcaagacttaaaagacagatatgaagcgatcggaggcatttcgccgctggcaaaaatcacgcaggagcaggcggagaagctcgcacagcgtttaaatgaaatccaggacgacgtaacattcaaagtgtacatcggattaaaacatattgaaccgtttattgaagacgcggtggcggacatgcataaagacggcattacagaagctgtcagccttgtgctcgcccctcatttttcaacattcagcgtccagtcatacaacaaacgcgcgaaagaagaagcggagaagctcggcggcttgaccatcaagtctgttgaaagctggtatgatgaaccgaaattcgttgattattgggtcggccaggtgaagaaaacgtatgagtcaatgccgaaagaagaacgggatgacgcgatgctgatcgtctcagcgcacagccttcctgaaaaaattaaagaatacggcgatccgtatcctgaccagctggaggaatccgcaaaactgattgccgaaggcgccggaattaccgattacgcagtcggctggcaaagcgaagggaacacccctgatccgtggctcgggccggatgtgcaggatctcacgcgcgagctgtatcaaaagcatccttataaagcatttgtatacgtgcccgcaggcttcgttgccgatcatttagaggtgctttacgataatgattatgaatgcaaagctgtgaccgaagaagtcggcgcaagctactatcgtccggccatgccgaacgcacagcctgaatttatcgacgcgcttgcagcggtcgtgctgaaagagctggacaagtagaattaaacggtaaagaaggcgataaaaatgagtggcgataaaaaacatctggtcatcatcggcggcggcataacgggattagccgccgccttctacatggaaaaagaaatcaaggaaaaacagctgccgcttgaggtcacccttatcgaagcgggcccgagagcgggcggcaaaattcagacggcgcataaagacggctacatcattgagcgggggccggattcttttttggaaaggaaaaaaagcgcgccgcagctcgttaaggatttggggcttgagcatctgctcgtcaacaatgcgaccggccagtcttacgtgctcgtcaatgagacgcttcatccgatgccgaagggcgcggtgatgggcattccgaccaaaatcgctccgttcatctccaccggtttattttctgttcccggaaaagcgcgggcggcgcttgactttgtcctgcctgcgagcaaaccgaaggaagatcagtctctcggtgaatttttccgcagacgcgtcggtgacgaagtcgttgagaatttaatagaaccgctattatcagggatttatgccggagatattgataagctgagcctcatgtccacgtttccgcaattctatcagactgagcaaaagcacagaagcctgattctcggtatgaaaaaatcacgtccgcagccttcgggacagcagctgacggccaaaaagcagggccagtttttaacactgacgacagggcttcaaacgttggtggaggagctggaacagcagcttacgctgacaaaggtgatgaaaggaacgaaagtcacccatatcggccgcgaggagaaaggatattccgtgacgcttgataacggcaaagtgctctatgcggaaggatgcatagtgacagccccgcataaagccgcggcgaaaatgctttctgatctgccggcggtttcatgtctcaaagacatgcattctacgtccgttgccaacgtcgccttaggttttcctgagggagccgtcaagatggagcatgaaggtacgggattcgttatctcaagaaacagcgatttctccatcacggcctgcacatggacgaataaaaaatggccgcacgcggcgccggagggcaaaacgcttctcagggcgtacgtcggaaaggccggagatgaatccatcgtagatctttcagataacgagatcattaaaatcgtaatggaagatttgaaaaaagtaatgaaaataaatggcgaaccggaaatgacctgtgtgacccgctggaatgaaagcatgccgcaataccatgtcggccataaggagcgcatcaaagagttcagagatgcgctgaaagcttcctatccgggcgtatacgcgacgggcgcgtctttcgaaggggtgggcatcccagactgtattgaccagggaaaagccgccgtatatgattcactggcttatttatttgaaacgtaccagcctccgttatcgtaaaacggaggttttttgcatgttcccgttctgtaaagggaacaccaataaagagaaaaaacatttgaatcttctttgcgactgtgataagttatcttatgtacaaaatgactaaaacgttcaaacggtcaatttaacgaggtgggaaacatgtccgtcgatcggaaaaagctcattctggaagcggcaacgaagtcttttacacaattcggctacaaagcaacgacaatggatctggtggcaaagcttgcaaatgtggggaagggaaccatctacacgtttttcaaaaacaaagaagaactgtttgatgatattttcaccactattttaagagaaatgaaggaacacgcagacgaagcgatgaaaccggagctttcatttcacgaaaatgttcaccgggcgcttatcgcgattttggaattcagaaaaacacaccagctgactattaaaatttttcaggagaacgctgagattggtacaatagccgttcaggatgtcattgcgaaaatggagcgggccattctgtcatacattaaagaaaagatagaaacagccattgaaaacggaagcattaaaccgtgtgatccggaactgaccgcttttgtgatgctcaagctctacatcgcgctgatatttgactgggaaaaaaaccatccgcctcttgaaaaagagacgatcgccgaattgctggaaatgtatgttggtcaaggattatctaaataatagatgatccttcactttttaggtgccgtgaccgttttgtcaaatgagtcagtttgcggaaggaggcaacagggttgaatacaataaaaagccagtggaaagacattgtaacgaacaagaaactgttaatccccatcattgccatattattcgttccgctgatctacagcggagtgtttttgaaggcgtactgggacccgtacggcacggtggatcagctgccggttgtcgttgtcaaccaggataaaggggcggactacgaagggaaacatcttcagatcggtgacgatcttgtgaaagagttaaagaaaaatgataattttgattggcatttttcaagcgatcttgatcaatcgttaaaggacttattaaatgctaaatattatttattggtcgagattcctgaagatttttctaaaaacgccagcacggtaatggataaaaatccgaagaagctggatctgaaatatcatacgaatgccggatcaaactatgtcggcgcgacaatcggagaaaaggcgatcgacaagctgaaagcctccgtgtcgaaagaagtgacggagcaatacgcaaaagtcatttttgacaattttaaagatattgccaaaggactcggcaaagccagcagcggcgccaagaaaatagacgacggcacgaaaaacgcgaaagacggcagcgccaagctgaaggaaaatttagcgaagcttactgaaagcaccgccaccatcggcgataaaacgcagcagcttgcagacggagcggcgaaagtgacaagcggaattcaaacgcttgacagctctatcgcaaaacttcagagcgcaagcgccgaaattcaagataaatcaggacagattgcttcaggaggaggccaagtggccagcgggctgaaaacgagccttgacgcacaaaagcagctccagcaaaagcttccggatttaacgaatggattaagtgcgttaaacagcaaggcgcaggaagtgtcgcaaaaagcggcggcatttgaagatgcgatcaattcagtcaacctctcagatattgaaaaagcggttggggagcttgagcagactgaaaaggaattgcagcagtttaagaaaaagctttctgatctgaaaaacagcctggatgcccgggatgacgcggtcaaaaaggtgattaaggacagtgatttcttaacggatgagcaaaaagcgaaacttgttcagcttctgaatgagaagcttccgaaggccgaccttccggatttagacaatatcgtcagccagcttccgtccggcggagatatccagcttccggatatgtcagtcataaaaagcgcgctggcagatgtaaaagcgaaggctgatcagctgaaagcactgcctcagtccacatcgaaactgtataacggcgcggcggcggtacaagacgcgattaaccagctgacggctggaactgataaattgtacagcggagcgcagaccgtctttgaaagccaaaacaaattaacggccggtatcggcgaatacaacagcaagttcggacagcttaaatcaggatcagaagcgttagtgtcagggagcggccaggtgtctggcggcttaacgaaactgctggacgcgcaaaacaaaatccatgacggctcgtccaaaattgagcagggtcaagcgtctctcggcaccggtttaagcaagcttttagacggcaccggacaattgtccagccagctgaaagatgcggccgatcaaacaggggacattaagacagatgacaaaacgtacagcatgtttgccgatccggtaaaaacggacgataacgcgattcattccgtgcctaactacggtaccggactgacgccttatattctctctatgggcttgtatgtcggcggattgatgctgacggtcgtattccctctgagtgaagcttcagggcgtccgagaaacggttttgaatggttcctcagcaaattcagcgtcattctgctcgtcggactgattcaatccgtaattgtcgccacggttctgttaaaaggaatcgggcttgatgtggaaagcacttggagattctatctctttacgatgattaccagcatcgcgttcctgtcgatgattcaattattggcgacaacgatgggaaatccgggacgctttatcgctgtcatcattctggtgctccagctcggggcaagcggaggaaccttcccgcttgaactcctgccgggattctatcaagtgattcacggggcactgccgatgacatacagcatcaacgggttccgtgccgtcatttcaaatggcgattacggctatatgtggcagcaggcatccattctgttgggcatcgccgttgtcatgatcgcgctgaccattgtgtattttacggtgcaaagcaaaaaagaacacaaaacggaagaagaaataacagcataagaaaaagaggcgctgagcagatgctcagggcctctttttttagatttcgattaaaatccccatctcaccaacagtccggtatacgtcaatccgccgccgaacccgaacaataccagcgtctggccttccgacagtttttttgctttcacagcttcatccaaagcgagaataatagaaaccgatgaagtgttgccgtaatattcaacgcttgtcaatgtccgttcaagcgggaaaggcagtttttcacagatggattcgatcatccgcatgttggcgctgtgaggaacgaaccaatccagatcgtcttttgaaaagccggctttttctaaaagggcattgcattcctccggcacggttctggccgcccatttatatacttcgcgcccgttttgcaccatatttcctccgcctttaagcggctcgccgtttaattctgcgctcagtcccgtgcgatacagcacgtccgcgcttcctcccgctgttccttgcacggctgccaaaaatcccggcgctgattcgtcgcgttccaccaatagggcgcctgcagcgtctccgaaaagaacgcaggtcgtccggtcagtataatccgttacctttgataatgtttcaccggcaatgacaatcactttttgatgggcaccggcggtaattaatgcgtctgcgagctgaaggccgtaagtgagtccggcgcatgtggcgttaatatcaagcgctcccgtgtgcggccagccgaagtaagcctgaacgcgtgccgcggtgcttggaaacgcatagtccgccgtcgttgtggcgacaaggatcatatcgacatcatcaagagttccgctgtatcgttctgcaaggtttttcaccgcttccacacacaaatccgatgtgaattcatgttcgccggcaatgcgtctttccttcataccggtgcgctggacgatccattcatcagatgtatcgacgatgcgctccaaatccgcgtttgttaatcggcgtgccggagcatatgtaccgattgctgtaattttagattttgacatgaaaaaatcactcctttatatcagattataacacctgatattattacttggtactaattttaataaaaaaacccaagcagcatccgctgtttggggagcatgagaaatttatttgtaaaacgggcttgtgtgaacgattaccaatgacggcagcagcggcggcatgaatgatgatgcttctttttgtctttcttctttttgtctttcttctttttgcaagggtcttcttttttctttttacagtgatctttttcttttttacagcaccagaaggctgcaccagaccaatcatcctcaaaccaatcctcaaaccaatcattatgaaaccttttccgcttgtgcggtttacggctgatcatacatttccctcctatgctcatgctcccttcattctatgaaaaaagagcaggaaaagattggacgggttatggatcaaaagagtatattttaagaagaataaaattgataggaggaatgacctgtggcaaatatgaaacatacgatggaactgattaaagaactggtgtcgattccgagtccgacgggcaatacatacgaggttatcgcctatacagaaagtcttttaaaagaatggggcgtctcctcttacagaaaccgcaaaggcggtctttttgtcacaattcccggccgtgatgacaagaaacacagattgctgacggcgcatgtcgatacgctcggcgcgatggtaaaggaaataaaggcggacggccggctgaagattgacttgatcggcggcttccgatatcactcaattgaaggggaatattgtgagattcaaacttcttccggcaaaacctatacaggcaccatcttaatgcatcagacttcagtgcacgtctacaaggacgccggtaaggcagagcggaatcaggagaatatggaagtccgccttgatgaacctgtccggacgaaggaagagacgtccgatctcggcatcagggtcggcgatttcatctcatttgacccgcgtgtgcagattacgccgagcggctttattaagtcccgtcatcttgatgacaaagcgagcgtggctctgctcttgaatttaatccgccgcatcacggaagagaaaatcgaacttccgtatacgacgcattttctgatttctaataatgaagaaatcggctacggaggcaattccaacattcctcctgagaccgtcgaatacttggctgttgatatgggagcgatcggcgacggccagtctacggatgaatataccgtctccatttgcgtgaaggatgcgagcggcccgtaccattatcagctcagaaagcatctggccgggcttgcggagcgctatggcattgattatcagcttgatatttatccgtattacggttctgatgcctcagcagccatccgttcgggccatgacatcgtccacgggctgatcggaccgggaattgacgcttcacacgcttttgaacgcacgcatgaattatcgcttcttaatacggcgaagcttttacacaggtacgttctatcgccgatggcataaaaaaccctgcgcggaaatcattccgtgcaggggtttcattttaacctgagatggttgtgttttgttctgttttggcgaggctcatgaccttcgcgcctttaacgggatcatattggccttcccattttgacatcacaacggatgccagcgcgtttccggtcagattgacgaccgtacgggccatgtccataatccggtcaacaccggcgatgaatgcaaggccttctgcaggaatgttgaatgcgcctaatgtcgcaagcaggacgacgaaagaagtcccgggcacggcagccattcctttggaagtgaccatcaagacaagcacaagggtaatctgctgccaaatggacaagtcaatgtggtatacctgagcgaggaataaagcggcgatagattggtacagcacagatccgtctaagttaaaggtatatccgatcggcacaacaaaggaaacaatacctttcggacagccgattttctccattttttccataacgcgggggagtacggtttcggagcttgacgtactgaacgccaataaaatttcatccttcatataggcgaggaatttgaaaatgtttactccggcaagctttccgacgattccgaatacaacaatgagaaagaaagccaaagctacatatactaaaccgaccagtttaccgagtgaaagcagggaactgagcccaaatttggaaacggtaacaccaatcaacgcaaaaacaccaaacggcgcaactttcatgacgaggttcacaacatggaacatcgcatgagaaacaccttcaaagaaggccaatacgggctttcctttttcaccgattgccgagatgccgagtgcaaacagcacggtaaagcagatgatggcaagcagatctccttcggccaatgattggaagaagtttgtcggtacgatatgcaggaatgtgtctgcgatagatttgttattttgttctttttctgtttcaacatattgactgatatctgttttttgagcttcatgtatattaacgcctgttcccggatgaaacagattcgccaaagccagcccgagaataatggcaaaagtggtaatgatctcaaaatacaaaatcgttttgaagcctaattttccgacttgttttccgcttcccgcgccggcaacgccgatgattaagctggagacgacaattggaatcactatcattttgattaagcgtaaaaacaaatcgccgataggctgtaaatatgttggaatggcaggattgccgtaccagatgacaccgactacaacccctagtatgagtccgacgaaaatttgcgtcgctagtccaaagcgtaattttttcatagattacctcccgaagaaaaaagtgcaataagtatctaaaaagatagctattagaacaaattataatagaaaagaaaacaatccgtctatagaaaaatatagattgaaaatactgaatcttttaaaacgtacagataattgctaataatggtgaataactccctattcagaaagtatgatgacggccgaaaaaaacgggcgccgcacaacttagaattgtgcggcgccctattgtcacatatccttaattttcaagcagtcattgcacaaattaatgtgacactcatactgctcaacaatctcatttccgcattcttcgcatttcttaccgggtaaatttctgaaaaaatccgacatcttttccaacatacccatccctctttcattgttttgtctctacattgtattataacagttttggaaaatcaacggctgttttggcacaatgtttaaaacatgcaatttgtacgaaaaataggtatattggaggaaaggatctttttatcataaacattcggagggtcatatgaaagttacagttattggatgctgcggcgggtttccggccgcaaacgaagcaacttcaggctatctgtttcagtccggcggctattctctgctcgttgattgcggaagcgccgtattatcaaagctgtttgcctatgttccggcagaagagcttgatgccgtcattttgtcccattatcaccatgatcatatcgctgatatcgggccgcttcaatttgccaaacaggtcggctcctttctcggaaaagggacgcatgcactgccgatttacgggcatgatgctgatatagaacagtttgagcgtcttacatataaaacgcatacaaaaggagtggcctatcagccggaccgcccgctttctgccgggccgttcaccattacttttctgaaaacggtgcatccggtcacttgttatgcgatgcggattactgacggtgcagcttctgttgtgtatacggctgattcaagctaccaggacgcgtttatcccgtttgcggaaaatgccgatctgctgatctgcgagtgcaatttttacgcggaccaggacggcacgtcagccggccatatgaacagtttggaagccggacgtatcgcggaggaggccggagcgggggagctgattctcacacatctgcctcatttcggcgagcaccggaagctgaaagaagaagcggaatccgtgttcgggggcgaagtgacaatcgccgcttccggattgaagtgggagaaataaaggaggagcaccatgttatttatcgacaaccaaaacataaccgacccgaggatcaacctcgcgatcgaggaatattgcgtgaagcatctcgaccctgaacagacatacctgctgttttatgtcaatcagccgtcgattatcatcgggaagaaccaaaacacaatagaagaaatcaatacgaaatacgtagaagataacggaatcatcgtcgtccgcaggctgtcaggaggcggtgcggtttaccatgacctcgggaatctgaatttcagttttatcaccaaggatgacggcgacagctttcacaattttaaaaaattcacagaacccgttattcaggcgctgcgccagctcggtgtggaagctgaattaagcggccgaaacgacatcgtcgcggacggcagaaaaatttccggcaacgctcaattttcgacgaaagggcgtattttcagccacggaacattaatgctggattccgccattgatcatgtcgtgtcagccttaaaagtgaaaaaagacaaaatcgaatcaaaaggcattaagtcaatcagaagccgtgtcgccaacatcagcgagtttcttgatgataaaatgacggcggacgaattcaaaaagcatctgcttcaccatatttttaatacaaatgatctttccgaagtgccggaatataaactgaccgatgaagactggaaagcgatccggaagatttccgaagagcgctatcaaaactgggactggaatttcggaaggtcgcccgcattcaaccttcagcattcgaaacgttatccggtcggatcgattgatctgcgtcttgaagtgaaaaaaggaatcattcaggactgcaaaattttcggtgatttcttcggtgcgaaagatgtgagtgaagtcgaacaggcgctgagcggaaaacagtatgacagaaccgctatcagggaggcgctggccggaatcgatctgaaacagtatttcggcaaaatagagctggaagatttcctcgagctgatttattagaacatttgccgaacgcatgatttgaatcagcacccgtttttgtgaaatgatagaaccataatgaatggggagggatcatgatgaaagtatttctcatcggagcaaacgggcagatcggacagcgtctgaccgggctgtttcaaaaagacggcacgcatacgctgcgggcgatggtccggaaagaagagcagaaagaagcgcttcaagccgcgggaacagaagccgttcttgcagatttggaaggaagcacggaagacatcgcgaaagccgctgaaggctgtgacgcgattgtgtttaccgccggatcaggaggaagcaccggatacgataagacgcttctgattgatcttgacggagcggcgaaagcgatagaagcggcaaagaaagccggcatcaagcggttcattatggtaagcgcccttcaggctcataaccgcgacaattggaatgaagcgctgaagccgtattatgccgcaaagcattatgcggataaaattcttgaagcgagcggtctgacgtatacgattatccggccgggcgcgttattaaatgatcccggcacgggaaatatcaaagccgcggccgatttagaaagaggctccatttcaagagacgatgtcgccaagaccgttatcgcatcccttgatgaaccgaatacgtatgaaaaagcgttcgatctgacagcgggcggcacgccggtcagtgaagcgctgaaacaattatagtttccggttttacggcactcggggctttttgcccttgagtgtttttctatatttttctataataaaagtgaacgtttattccggataaatgaatgactattcattcattatatttttaaaggggtgggaaaatgaatctggtttccaaattggaagaaacggcatcgcagaaaccggaaaaaccagcttgtctgtttcaagatcagtacatgacgtatgaggagctggcaggtaaaatcaaagcatttgcaaacggcttggaggacaggggactgaaaaaaggggatcatctcgcgctgctgctcggaaatacgcctgactttgttattgcgtttttcggcgcgttaaaagcgggaattgtcgtcatacctgttaatccggcatacacaccttcagaaatcgcatacatgctgaaaaacggcgatgtcaaagcgatcgccggcatcgacctattaattcccgtatttgaaagcctgcacggctcgctgccgctgctggagcatatcattatcagccagacagcagagaacgctccatcgacagaagaccctcaattgcgcttaaaaatgacaacgtttacaaaaatgctccgtccggcggagcgcagcagaacttatccgacattgtccaaagacgatactgccgtcattttatacacctcagggacgaccggaaaaccgaaaggcgccatgctcacccatcagaatcttttctccaatgcaaatgatgtcgccggatacttaggaatgaatgagaaagacaaaattgtggcggcattgccgatgtttcacgttttttgtttaaccgtttgtatgaatgcgcctctgatgagcggagcgtgtgtcttaatcgagccgcaattcagtccggcttctgtgtttaaactgattaaaagccgacaggcaaccatttttgccggcgttccgacgatgtataactatctgtatcaatacgagcacggcaaggcggaggattttgcgtccgtcagactgtgcatttcaggcggggcctccatgccggtcgctctgttgcagacgtttgaacaaacctttgacgtcaccattctggaggggtacggactttctgaagcgtctccggttacttgttttaatccgtttgatcgggggagaaagcccggctcgatcgggacgaatattttacatgtcgaaaataaagtcgtcgatacgctcggacgcgaattgcccgaccatcaagtgggagaattgatcgtgaaagggccgaatgtgatgaaaggctattacaagatgcccgaggagacggagcacgcgctgaaagacggctggctgtacacgggtgatttggcgaagcgcgacgaagacggttatttttatatcgtcgacagaaaaaaagatatgattctcgtcggcggatacaacgtctatccgcgcgaagtagaagaagtgctctacagccatgagggcattaaagaagccgtggtcatcggcgttcctgacgccaaaacgggggaagcggtgcatgcttatatagtgcctggggacggtgagctgacagagcaggctgtttttgattactgtgaaacacatttggcaaaatataagcggccggcggaagtggtttttcttgatgagattccgaagaacgcgaccgggaagctgctgagaagggcggtccgggacatgcttccgaaatgacggacgaaaagcgaagccgggggcttcgcttttacatgctgatccggtcagctttgcgattcttccttaatgatgctttgcacaagcttcgtatcatgccgggtcagtttgtaatacgtgtttttatgcttgtacatcatataattgccgctttcgagccacatactgaatgaatcaaaacggtcttcatggtatttgaccgttccgtcgtaatcgggagacacgcttttggtcagtttgacttgttttccttggttcaagatatcgagcatatcttttacattctgcctgtctttaattttgatttctttttttccgtgctctgacagaataatcagatctgcgttgcttgatggaaacacatcgccggtccggctgtatacatagaagaaagcaataaccaaaagggcgattactacaataaacgcgattatttttttcatattcatcactccgtcttttagtctttcccgcttcctgttgttccattcttttctgttgtgaaaagattaacatccgtttcggaggcttggttctatttatttgcatttatgcttacaataggagtaagtcataaggctaaggagggagacttccatgcgcaaatggatagcggcagcgggacttgcctatgtgctgtatggcctttttttctattggtatttctttatgacaggagactccgccgtcccggaggccgtaaagggaacgaaagccgatccgtcctcgtttatggagccgggccgcctggcagccgctgaaaacttttcaaatgtaaaggattttttatttttcatcggagcgccgttagattggtttttattttttctgctgctcattacggggcttgccaaaaaaataaagcattggctggaagcagcggtgcgctttcgggtgctgcaaatcgtaagcttcgtatttgtgatttcactcatcgttacggcggcttcgcttccgcttgagtggatcggatatcgggtttcgcttgcgtatcatatttcgacgcagacagcatcaagctggataagagaccatgtcattgatttctggatcagttttccgctgtttgccgtgtgtgtgcttgtgttttactggctgatcacaaagcatacaaaaaaatggtggttttacgcttggtgtcttactgtgccgtttaccctgtttttgtttttcctgcagccggtcgtgattgatcctttatacaatgatttctatccgctgaaagacaaggagctggaaagcaaaattttgtcgcttgccgacaaggccgacattccggccagccatgtgtatgaagtaaatatgtcggagaaaacgaatgcgctgaatgcgtatgtgacgggcatcggttcgaataagcggatcgttttgtgggatacgacgcttaacaaactgaaggatcgggaaattttgttcattatggggcatgagatggggcactatgtgatgaagcacgtgtacatcggactggccgggtatctgctgctgtcattagccgggttgtatatcattgacaagctttataagcggctgtccaaattcttcggccgaatgcttcatataaaggggcctgaagatctggccgcccttccgctgttattgctgctcatatccgttctcagttttgcttctgatccgattacgaacgccgtctcccggtatcaggaaaacgccgccgaccgttacggcatcgagctgaccggaaaccgggaagcggcgattgagacgtttcaggacttggccgatacgggactgagccgggtcaacccgccgtttctcgtcaaaattttcagagggagccacccatcgatcatggagcggattgaacatgcggaagaagaaaaataataaaaaaaccggcggggccatgcccgacgccggttttttatgttttactgagctgccgcctgtacgttgatcagcccttttccgtagtagaaagcatcaccaagttttgtagtagtgttttctaaactgctgcggacttgagtgtttgtccagttcgggtgcttagaaagaatcaaagcagccgctccggcaacgtgcggagatgccattgacgtaccattgtacgcgccgtatttgtttccaggaagcgtgctttggatagagacgcctggtgccatgacatcaagctcagaacctacgcttgagaaagatgctctttggttgctgctgttaacagcgcctaccgcaatgacagaagggtatttaccagggtagcccactgtgctagagccgccggaagtgccttcgttaccggctgccgcaaccactacgactccggaagcaacggctttgtcaactgccgcttttaacgctgcagaaccagaaggtccgccgaggctcatgttaataacgtccatattgtttgcgatcgcccactcaattccgttaatgatccagctgtactggccggaaccgtcagcgccgagaacttttacagcgtaaagagatgcgcttggcgcaacgcctaatacaccgactgagttattaagagccgcaactgtaccggcaacatgagttccgtgagagttgttgtcttggaaaggatttgtttcagaaggaaccatgctggctccgcctgctacctttaaatcaggatgagaagaatcgataccgctgtcgataaccgctactttaacatttgatccggtgaagccttgagagtgcagagcaggggctttaatctgtgatacgccgtaaggcacggactgcgcgtacgcttgtgcaacgtgatcttcttcaacgtaagcgacgctagggtcttttttcagctcttttacagctttttcatttaatgtagctgaagctgcgtctacatatttgaattgcttttgcactttcccgcctttttcagaaatgacatcttttttcttggcggcgctcatcgtgctcattgtctgcttaaatccgacaatatatttcttttccccgtttgatttccctgcagcctgggcagaagtcgtgctgccgaacgccatcgtaaagattaacgctaaagcaaacagcaaactgatccatacctttttgcctctcactctttatccactccttttttcatttgcagaataaccaatagacagattattctgtggattaattgtatagtatggaataatattttagtagacccaatttttttcagtttgttttatttctatttaggtatatcatctctctttcgtttaataggaacccgaaatatttaaattttaatggaaaaaaccgatggaaggacatgagtatttgtacacagccgcaatcgctctcttgtttactgggtcgaacggtttgattccatttttggaagctgcggcaaaaacaggataaatgtcaccttttgttgaatgcagaagtctgatggaaacgaaagcggaatgaaataaagcggccggcatgaatcagtctttggctttcttgacggagaaagctgtgaaaccattttatgaaaataatgatattgaatatcattgatacttatattgtcaatgatataattgcggaaaaacgaaagagggggaacagatgaaaccaattttcagtatgctgatgatcttatccgttctcttcataacggcatgctcagaacaggaacatgaaaccgccgtcaggcacgatctggggacggcgcatgtggctgcgcacccgcagcgcatcgccgtattgaatgagggctttattgacaccctccatgatctcggcataaagccggcggccgcggcggataaccggaaagagcgaaacgacggcagtccgtccgtcgggccccgtcacatcccgatttgaaaaagatcacttcgttaaaacccgatctcatcattgcagactcaagcctgcacagggggatataccatgagctgacaaagatcgctccgacaatcgctttgaaaaatgaagctgcggattatcaggatgcggttgatgctgcccttaccattgaaaaggcggtcggtaaagagggcatcatagagaaacaattgtcggctcaggaagaaaagctgaatgacatcaaaagaaagctggatgcagaaggcggcacgattttattaattgacgctgcaaatggcagcatttccgtaaaggatgaccggtttttcacatcccggcttatgacgctcgcagggtttacatatgcggtccagacagattccggcgggaaatcaggcgctatcaaaatgacgcccgggcagcttttgcatatcgatcctgattacatcgtactattggacggtgagaaagaactcgaaaaaaatcacctctggaaacagctgactgccgtaaaaaacggccgcgtttaccgcgcggacagggcggtatggacggagcgccggagcattgacggtgcggacgccgtattacatgatctgcagaaaaaaatgctcgccaaaaaggcccaaaactaattcgggcctttttgttatgattctgataggtggctgcttacattgtaatctttgacgcgccacttattttcaattcgttcgatattgctcaggcacgcattgacaagctttgcgttttgtatgtcggtatcaccgtcagaaatggcggacaagagggcgtgaatggctgcgccgtgagcgacgatcagtactttttgctcaggaaaccgctcctgaactttcactaaaccggcaagcattctgtctgtcagctcttctgcggtctccatgttcgggtagtttttatccgggtagcgcttcgaccgttccggtaaagacattccttccgcatcaccgtagctccgttctctgaaatcttccatgacgacaatgggaagattcaaaaaaccgttaataatgtcagccgtttttctggcccgtttcatcgggcttgagacgatgacatcccattcggacccctttaagtactctcctgtttctttcgcctgacgctctcccgtcgcatttaacggaatatccgatttgccttgaagcttcttttgggcattccaatcagtctctccatgtcttactaaacaaacggcagtcataaagtctccactccgatcattttttatcgatatcatctattatactgccgttacgttaacacttcaaagagaagcgccagtccgactccgcctccgctgccgatcgctgctgctgcatagcgggcatcagggcgtctttttgcttcataaaaaagccgggtgacaagcgccgccccggaagccccgtacggatgcccgacggccagagcgccgccccggacatttattttagaatacggcacttgaagctgctgtgaaaaaacgcatattttgacggcaaacgcctcgttgatttcgtatatatcaatatcatccggtgacaggtcccgttccttcaaaagctttttgacggcataaaccggagctgctgacggataatgcggatggacgccgcttaccgcgcttccgataaaacgcaatcccggctttaaaccgagagaccgcgctttttgttcttccatcacacaaactgccgccgccccgtcagaaattccgcagctgttggcggcggtgacagagcctccggactgaaagacgggtttggcgcgggcgatgagaggcgccatgttccgctttttcagcatgttttcgtcagcggcgaatccgtggcaggggagaatttcccggcggtacaagccgtcttcgtgcgctttgacgctccgttcatagctgagaagggcatattcgtcctgcatctttctcgttacgccgtaagcctgtgccgtatactcggccgctatgcccatatcaggatcgccgatgtgttcaggagaaaagcgcgcccgggatgagaaaggggaaaggctgctgctctccgctcctcccgcgatgtatgtgctccccgcgccggctttaacaaagtggcacgcgattctcacggcatccaatccggaaccgcactgcctgtcgatggccgtaccggacacgctcaaaggaagcccggcggccaaggctgacagccgggcgaggttcccgccgcggcccgtcgcgtttccgagcaggacttcatcaatgtcttcgggcatgttccggctcaaatgtcggatcagcagagctgccaaatcttcagggagacagtcttttaacaggccgttttcccgggcgaaaatcgtccgcttcgcatccgtaattacagcttccattccatcatgtcctttgcctgcttttgtacggcggcacgggcgatctttccgccggctgtttccggtatttctgaaaacagccattttttcgggattttatatgccgccagctgctcgcggcactgtttcttcagttcctttacatttgcatgtccgtcgatcaccgcaacggcgatgctgccccaataatcatcaggaatgccgatgacggccgcttttctgacgcccggacagcggttgagcacacgttctatctcttccgggaatacattcaggccgcctgatacgatcatcccgttttcacgtccttcgatataaagatagccttcatgatcgatatatcccatgtcatcaaccgtcatccagccggaatcatcaggctttgcgccgttgatgtatccggaaaatttcatcgggctgttcacaaaaatcttccccgtttcgcccggcatgcagcgttccccgccgggccggcggatttcgattgtaacattttcaaacggacggcccgccgcgtcaggctttcgggcgctgtcttcaggcgataagaacgccacgaaactcagctcagacgttccgtaaaaatcatacagccgcaaatggggatagcgctctgacagcgcttgtttagacgaagcgggccagtctgcaccggaagaaatcaccttgagcggtgtatccggaaacgcctctagtgagagcagggcgtccgtcattgtcggaacggtatatagaacgtcagcttgtctgagccggtctttcattccggccggattgaattttctttgaaggaggacggttccgccgataaacaaagtgctgacagcgccgtataaaaagtgtgatgagcgcagcgtgcccggcaccagcactttgtcatcaggggaaatgccgaattcacgtttcgtacaagaaaagctctccagccacgaacggtgagagcgggtgaaggctttcggcttaccggtcgatcccgaggtgaatccggtataaaagggcaggcaggcgtttttgataaaagcgccttccgctttttccgcctcgatcaaaggcctgcattcatcccacaggatgacaggcgttttgatgccgtccagtctgccgctcagccggcggtcacagatgacgagatcggttttgctgatgtgcagctggtccgcgagttccgccgccgccgagcggggatctaacggaaccgccgtgcagccggcatgcgccgcccctgcgaaaagttgtaaaaatgggatgccgttcggcagtaatattgcaatgttttccggcttacctgaaaggctgccaagccagtttgcggtttggtttactagcctgttccaagtttgatagttgatctgttctgtttctgtctgaatcgcgatctgttccggcgcttgtccggctgtatctgaatatgatgatgtaatcatgatgactaaaatcagcttcctttcgtcggcaaaagccggctagcttgaagagtttttctgattcttacggctgcgaatgaggctgcggccgctttaagcagatctccgggcacatagatgaggctgagctttacggcagtcaagatatcaatgtgcatcataaaagcctgaacgggaatgccgatgacatacaaaaacagcacgccgaacaagaactgtctgataaacaaatgggggacagcagctgagcgaaggccttggatgctgaggctcagcagtaatgccgccagcggatatgcgatgagatatccggcgctcggcccgaaaaaaaccccgaagccgcctcttccgcctgaaaggagaggcgctccgcatgccacaatcagcaaaaaaagcaattggcttaaaaacgccgctttcggtttcaggatgcttcccgataagagcacaccgatcgtctggagcgtaatcggaaccggcgtaaaggataagaaaagcggcgggagcagccccaaaagtcccataatggcggtaaacacggcaatatgcatcatttctgtcaatttcattatgtattcctccagcttatcaaaatatgtttatacaataaagcgagtctttacatatgtcaactctattatattttaagttaacaataaaaagaccggccctttatgaaaaaggccggtcggtttatctttattcttctgtaaggataacaagtgaatcaacggatgatgcaacgtgggaaacggcgcggctgacttcttgaaggccgccgagaaaggcctgcaaatcaacgtcgattttgcctgtctggtctttgctcgttttcatgctttggacgatgtcatcaaacagacggttgatctgcgtcattttttctttcgtttcgcttacaagtccgtttacatctttaatatgtttggacacgatgttgatttgtgtattggtattgttcacaagctctgatacggtggaaacggtttttttcgtatcctctgaaagcttccttacctccgtcgccacaacggcgaaccctttgccgtgctccccggctctcgcggattctattgaagcgttgagtgacaggagattcgtttgctcggcgatccccgtcacgatgccgaagattttttcgatctgttgggcgatgtcattcagcttgtccatttcttcttcaatctgcagaaggctggcgtcgattttattcatctgctgctgctggctttcaagctcttttttcccgccgattgatttttcttcgacatgtacggaagtgacggtgccggcttttgacgcctcggaaatgccctcggatttatcgaccagttcctgcacggctctgctcgtttctgaaaacaaatcagcgagtgatccggatgtttcctggattttctgatgaaggcgggctttcttttcctcttgttcgtcacgctggcagttatattcagtctggaatgcttcaaggacgagctgctgttcaagattcaatattttcgtcgtcgctttgatcgcttttaaaagctcatgcaaatccggaatggttgcttcatatatgttcatcatcgacagaagcagatcctgaaacgctcccatataccatttcggttcaaggccgatccgcaagtggatggaagcgatgcgctgtcttttttcaatgaattcatcatcaatcgtgccggcgaacatctcatggatatgacgccgtaatgtttttttcagtcgctcaaccgtgctgtggtcgttaatgatcgtcattaatgatttttcgtgatccagatttcggtaaaaggaatcgacgattgttgagatatgttctttaattaacggctgcagctcttcaagcacatgaagttcttcgtttccgagcctgaccattttcagctgtttttggacatctgcatattgatttgaaagcgcgatgcgtttttttccatcggcttctgaaaaatatgctgtttcttttttgcggtcttttttaaataacaatataagttcccccagatattctctttttctttttatcggtttggaaggaacttgaatgaaggaatctgataaaaatattttaatgcggaaaaaaataaaaccattcgtacagaatggtttagtcaatcttgggtgagacgtttcagcggcttgatggcgggaccttcggcaaccccgccgtcgggtgtgaaccgggacccgtgacatggacagtcccacgtccgttcgccgtcattccattcaacctcacagcctaaatgggtgcatgtcgtatcgacaagatgcagacagcctttttcatctttataggcgccggcccgtttgccgtttaccgttacgatttttccctccccgggcccaagactctcaggtgaagcgtccggcctctcaagtttgcccgagataaggtgtttggccacgtcggcattataggaaatcagttttttcagtccgggatctgcgtggaagcgtgacggaataaacaggccggaaaacgggttctttttgttttgaatatgatcagccaaaagcttcgcggcgagcgctgagcttgtcatcccccattttttaaaaccggtcgccgccaaaatatgttcttcatcgcctgagatgggaccgatgaacggaattttgtcaatggtgacaaggtcttgtgcagaccaatgatatgggatgctttcaactccgattgtgtcttccgcaaattgtttcagcgcttcgtaatgcccggacatttcttttccttggcctgttttgtggctttcaccgccgacaagcaccagtttttcaccgttcaaatcggtgtatcgcagtgatctggacggcttgtctatgctgagatacatcccgtccggatacgcttgtttcggttttaccgcgagtacgtaggatctgctggcatacattctggcggcataaagcccgcctccgtcataaaaaggaaagtgggaagcgcagacaatgtagctgcacttgatgccgtgtctgtttttcgtgaccacttccggctgcggttctttttttatgtcgatcgcagccgtctgttcaaaaatccgcgccccgtttttaacgatctctttcacgagcgccgcaccatataaaagcggatggaattgcgcctgattcttcatggcaaggccgagcctgcaatcaacggggacgggaagttctttcacaagctcatgttcaataccgagcttggtataagcttcctgctcactgcggatttttttgacgcctgattctgtattcgtgtaaagatatgcgtcttgttcaatcagtctgcagtcaatcgaaaggtccttgatgatctgcttcatgtcttccatggcgcggagatgggcttcgaaatacagccttgcgctggtcaggccgatctgctgaataagatcggcatagatgaaatcatgctgggcggtgatttttgcggtcgtgcccgcggtcgtcccgtttaaaatccggtctgcttcaatgacagcgacacggaaaccttttttcgtcagttcgtatgccgttgtcagacccgtaattcctccgccgataaccgcaacgtcgcattccgtatcttcagtgagggcgggaaaggaaggaatgtcagctgttgcttgccaataggaagccggttcctcgtttgaaaaagtagtcaattcagatttacctcctctgttgtatattcttaatttttccaataagactctgttcatacatgaaattcgtataagatgctcaaattactcataatatagtaattaatgtaaaggagtgatcaaaatggcgaatcagaagaagaaaaccttgccgccgcagcatcaaaaccggcagccgggctttgaatatgtaatggacccgcgccccgtttttgacaaaccgaaagcggcgaaaaaacttgaagggaaaacggcgatcatcacgggcggagacagcgggatcggccgcgccgtatccgttttattcgcgaaggaaggcgctaatgtggtcatcgtttactttgatgagcatcaggatgccgaagagacgaagcaatatgtagaaaaagagggggcgaagtgtctgctgatcgcaggggatgtcggcgacgaagccttttgcaatgatgtcatccgccaggcgggccaagcctttccttccattgacatcctggtcaacaacgcgggtgagcagcacgtgcagccggggattgagaaaatcacgagccaccagctcatcagaacgtttcagacgaatattttttcaatgttttacttaacgaaagccgcgctccctcacctgaaaaaaggaagttcaatcattaatacggcctccattaccgcctataaaggccacaaaacattgattgactattcagcgacaaaaggggcgatcgtcacgtttacaagatctctttcccaatctcttgtcactcagggcatcagggtaaacgcagtggcgccggggccgatctggacgccgctgatcccggcgagcttctcggcgaaggaagtggaagtcttcggctcagacgtgccgatgcagcgcccgggagagcctgttgaagtggcgccgagctatttgtacttagcaagcgatgattcttcctatgtcacgggacagacgattcatgtgaacggcggcaccatcgtaaacggataatgtaaaaaaagccaatccatatggattggcttattcactctgtttgagagcggcatattcttttgaaagcgtgaggaacgcttctttatttttatcatcaagcgccttattaatctgcattgtcagcatggcgatccggcgtttatacaaggattcatcaagcaccatttgaatgtaaatatcggccattgtcacatcgaattcgtttgctttttccgtgttgcgggacttcatgagctcagtgtacgactttttctctttcataaagaatccccccaatgccttttttatagtatatggataacggccggaaaaatcaattaatttttataatctttagacaactaatacttggaaatatatcgacatatcctgcaaattgacgaaaaaacgaaaatgatcgttgtataaatgaggtgaaatgaaaaagaaaaataatatttaaatagtaatttaagactaaattacagctttaaaaggtgatttttagctatattcaaaaaaaacctgtcgttttccaatgacagatgatagattattagtataaattttcaagaaaaggattggaggctgcacatcatgtgccagaaaacacacgcacccttagaaagctacgaagtaaatcgttcaaccatcgctgttttgcctgaggaaatagacggtaaaatggggtcgaaggtcattgaaaaagactgcattctgtatgtcagcatgaagccgattcacatcatcgacagaagctgccgctactttggctccagctatgccgggagaaaagcaggaacatatgaagcgattaaaatttctcacaagccgccgattatggtggacccttcaaatcacatctttttattccctacactttcttctgcaaggcctcaatgcggctggatatctcatgtgcacgttaaagattttcaaccgacggcatttgatgacacagcggtcacgttctcaaacggcaaaacgatggaactggaagtatcctatcattcttttgaaaatcaggtttacagaaccgcctatctcagaaccacttttcaggacaggatgggcagtcatatcccgaagcggcaggaattcatgctgtatccgaaagaagagcggacaagaatgatctacgactttattttgcgggagctgggggagagatattagagaaagctgtgatgtgaagggacgggccctttccttttaggaagggcttttttcgatttacatgcccggatagagttgtatcgtgtccgtctgttggctatgatgatgtaaagagtaatgatatttcattttaggagagatgggcatggatgtgtttgcaaaatatgtatcagaaatcgataatccggatcaccgtctcaaagcagaggaaattttgtcgtggacggctgaccaatttccgaacttagaagcgcagatcaagtggaacaaaccgacatttaccgatcacggcacctatatcattatgtttgccgcggcaaaaaatcatttgagcattttgcctgaaaaagagacgatggagcattttgccgatgacatcgcccaagccgggtacagcgcttcttcacgcctgttcagaattcggtggactgatccggtgcactatgatctgcttaagaagatcatcgaatttaacatcaaggaaaaagctgaaaatccggggttttggcgctagcggacgtgatgtagaaggaggaagacatggacgttttcaaagactatttatcaagtatcgacagccctgatcatcgtctgcgaatggaggaaatcctgtcgtggacggctgagcaattcccgggtttaacaccgcagatcaagtggaacacgccgatgtttaccgatcacggcacgtttattatcggctttgcggcagcaaagcatcatgtaagtgtttcccccgaagaagctggaattgcgcattttgccgacgacattgcccgtgccggctacagcgctacttcccgtttgttcagaattcaatggactgaaccggtgcattatgagctgcttgaaagcatgattcaattcaatatccaggataaggcggactgctcagcgttttggcggaaataatgaaagaaatgttaaaaaacaaccctgaggagggctgtttttttattaaacgtaatccgaaaaataagggatttgcgtatccggcagaccctcacaaacgcacgatgacagaaatcgtgcgttcaaaattctttatttgacgacagacatgctgacgctgcttcctgacactgtcaatttggcaaaatcctgtgtatcaatcacaggtgtgactgctttattgtcgatcgtgatgttcgtaaaggctgttgagaagtttgatttgatgtaagggcgctgatcctctgatgtgaccgcgacggtggcgagcgctttccattttgagacagagcctacatttgtttgggcgagttctgagatgatgcggccggtgtatccgtcattattcgtgccccaatatgtggcgcgggtattgccgttcagatttttgtaaatggtcagctgtacggtgctgccgggccggaagcctttcgtataagtgaattggctttctccttccagataccggacctggccttgtccctttgaaccgactttcatgatcggtttccatacatgataggtgtcactgtactgaagcccgatatcagcctctgtgcctccggtaaatcctgagtaaatataggctgtcccatttgacacctgaatcgagcttggaagctgaattttcgtgacgagaactgagcccgtgctgttcagataggcccttccgccgattcctttactgagctgggacgccgcttccgccgtatttggactgatcacccccggaatatccgccgtacatgcgccgaatagaacggctgtagtgagaacacccgcaacaagcccttttttcatcatcatttctcctcctatcatcatagtcagatagcgctatcaattcatattataaaaggttttgggaaaaattccataaaagatatacgggcggacataaattaaaactattttcctatttatcttgtaaatggagattatttgaactatgatatgttcagccatacaacatgattcaggaaaggggataggatagaaatgaaaaagacggcagctgtgcttttgtctttcggcctggtgttcggttgttcatacggagcggggcagacggcagaagcgaaaacaaaggtaaaaacgtatcaaaactgcaaggcgctgaataaggtgtataaaggcggcgtggccaaatcgtcgaaagtgaaaaacaagggcggcagaacaaagtacaacccgtatgtatcaaaagcgctttacaatgcaaataaaagacttgaccgggataaagactatatcgcatgtgagaaataaaaaaacaagcctctttaaagaggcttgtttttttaaatggattcggcggtgacggcggttccgtatccgattaattcggatgtgttctgtcctgcggtcagttcgaaccgcaggccgacgatggcgttcgctccgagctgctccgcctctctgatcagccgctctttcaccgcttttttggagtcatccagcatttcggtatagcttttcaattcgccgccgacgacagattttaagccttcaagcaaatcttttccgatgtgacgggactggacgatactgcttgtcactaagccttttacttccgtaatctgttttccggcgacggtttcggtcgttgtcatgatcatgcggctttcccccttcatgtgtcttaccgctattttatcattaagccgccttttcggctgcgctgatttgtttttttctgactgcggcgctgactgcaaacatgacggcaatgttcagaaccagcgcgatgatgcctgtattcatatccttaacgatctgcggaagaaacggaaagagggttccgacggttgattcggtcagcgtaatgaaggccaccgttccgaccccggccgttatgccggcaaaagcgccgtggcttgtgatgaaacgccgcttcggcaggctgaataagagggcggggaaaagctgggtgacaaggctgtagcccattaaaagcaaggtgacgatggtatttccgcctttcagcgtaaaatatacggatatcagcgcgatgacgggtacggcgtattttgcgagccgtgagactttttcgtcagtcgtgccgggccgaatggctttgtacacgtttttggcgaacagcgtgcttgaggccattaatatcattgaaccgggcacaagcgccgtcagaatgcccgccgatccgatcagtccgacaaaccagggatcaaaggttttcacagacagctttaataaggcgagatccgtgtccgccccttttaaaccgggcacctgcagaatcgccgcaaatccggtaaagatgacaaacagcaggacgagctgataaagaggcatgatgatcgcgtttttccgaaacacccgcggatgctccgccgaataggaagcggcaaaggtatgaggccacatataaaagccgagggcggtcagcaaaaccgttgagctgaaccaggaaacgctctgtccggtttccggcagcgtgagaaaaccgggttttgcggcgtcaatttgtttgaacatctccgtaaacccgccatagtaatgaatgggcagataaatgcctaaatacaggacgatgcctaaaatcatgatatctttgacgacggatatccacgctgaaccatggattcctgaaatcatcacataaatcgtgatggagacagcgccgatccagacagcggcggagggcggaatctgtccgtatgatgttgctgaaacaattaatccgagccctttcagctgcagaacgagataggggatgagggatgcgatgccgacgagcgatacgagaatgccgaggagcgggctgttgtattttgaaataaaaaaatctgattgcgacatcagtttgtgttgtttggcgtaagtccacacggctggcagaagccaatatgacaaaatgtaggcaaggcagccgtacgcgataatataaaaggccgggcctccttttccgtaagcccatccgcttccgccgaggaatgtaaaggtcgtgtatatttctcccgccattaataaaaagacaaacatcgtgccgaagccgcgtccgcccaccgtccattgttcaaggtccatatgttttccttttcgggcccggattccgagatatacacaaaacaggagcacggcggccattacgggaaatgctgcgttcattccgtctcacccgccttgttttctttgtccaatttgtaaacggcggccatcagaacggaagtcagcaccgcccagatgacgacatatgcgagaatgaaaggcattccgaaaacataaggcgtcacccggttggcaaatggaatgccggcgagaattccgaaaaagggcagggcggcgagaacatgaatcagtttcataacattcctccttttcattgaaaacagcgtgtcccgattataaagaaaatcatgtcgaatgtatagtgtgaatagtctgaaatttatcaactgaaaaggaaaagcagtcccggctgctttttaaatggtcgcaagagacaggtaatattccaataaggcggttacctgttcccgtattctcgggttgaaataacggtgtttttcttcatagccgttaatggtgcatatataaagcgtaaatgcttcgtctctttccgcttcgtatattttaattttacgctttcttaactcttttcgaacatcactcaaatccttttgtgctaattttaaagagcagctgataagctgtttatagggttgttttaatttgaacgggcacgaatcaagcgcttcgaggtcccggttcaggatggcagccgccatgggcagaaacagccctttttcgatgagatcgcgggtgccgctccgaatgtcaggcataaatactccttctttcttaaaaagagaacgtttgttcttattttatgctcgcttacacgatatttcaagtcggaaaatctcgtaaacattttcgttttttggagataatgtgtagaataaggatagacaaactcgttaaggagtataaacgttggagcaatttttatcatatttgactgaggaacagctgacggaatggttccaaagctatagagctttcggcccggctgctgcggctgtactgccttttattgaagcgtttcttccgtttttgccgctcgttgtatttgtggtggcgaatacgaatgcatttggtttgtgggaaggtttttttctgtcatggctcgggtctgcgtcaggatcgatgctgatgttttatgccgtccgccgtttcggacagaaaagagctttcggtttcatccgcaggcatcagaccataaggcggatgatgctctgggttgagcggcacggtttcggtccgctgtttattttactttgcttcccctttacgccgtccgctgcggttcatatcgttgccggtctgtcacgggtgggggcgctgcagtttatatcagcagccgctatggggaaaatggttatgatctttatgatcagctttatcgggtatgatcttcacgcactcatgacacagcctttcaggatggcgggcgccataatggtgatcgcggtgctgtggtatgccggaaagcatatcgaacggcgtttacagacgagaatcagtcagcatgagaaagacggagggagacaggaatcttgaaaaaacgattttggtttatagccggcgtgcttatcgttgttttggccatacaattaaagaatgccatttttattgattataaagtcgaaggaatcagtatgaatccgacctttaaacaaggaaatgagctgatggtcaacaagttttcccatcgttacaaaacgatccgccgtttcgatattgttctgtttaaaggcccgcaccgcaaagtgctgatcaaacgtgtcatcgggctccccggcgagtcaatcgcatacagggaggatcagctgtatgtgaatggaaaacgggtggcggaaccgtttttaaaaccgttaaagtcatcattgtccgccgggagccatgtgaccggtgattatacgctgaaggaaacgaccgggcgcaaaagcataccgaagggacaatactttgttattggcgacaaccgcatatacagcctcgacagccgtcatttcggtccgattaaggataaagacattgtcggagtcatcagtgaatcagacgccaagtgaacggcgtctttttttcggaaatgattgtcaaaaagcggaggaaagactataatgaaaattgttacgcacgaaacaaaaaaggaggcgtttattttttagtggttttgttacgtgtgtaacaaaaaaggaaagagggctgatgagatgaaaacacaggttgccattatcgggggaggtccggtcgggcttatgcttgcatcagaactggcgctggccggagtgaaaacgactgtcattgaacgattgaagaagacggtgccatattccaaagcgcttatcatgcatccgcgcacacttgagctttttgccatgagaggcatattggaacgctttgcggatcaagggacgaaggtgtcttccggccatttttccatgctggatacacggctggatttttctcggctggatacgaagcagaattattcgttaatgctgccacaggcagaaacggagcggatgttggaggagtatgcatcaagtctcggcgcagacatcatccgcggggcggaagcggtggctgtcacccagacggatgacggagtggagacggtgttccgggacgaaagcggaatccgcactcttcacagcttatatgccgcgggtacagacggggcggggagcattgtccggaaacaggcgggcatcgctttttcgggcacagatgccgacttaacaggaaccctttgtgatgccgctttgaaacatccgcccgaatcttcctttttttcaacgtgccgcctggagggatcggttgtgattatccctcttacggacggacttttccgcgtcctcatcgtttctccgcacgtcctgcaaaagcggaaggaagagccggtcaccgaaaatgagctgaaagaagacctgcggcggatatgcggcactgatttcggattgagtgatccggtatggatgtcgcggttcggcaatgccgagcgtcaggctgagcagtaccgctccggccgggtttttgtggccggggatgcggcgcacattcattttcccgcaggcggccaaggcctgaatacggggcttcaggatgccgtcaatctcggctggaagctggcggcgcaaatgaaaggaaaagcggcgcctcatcttctggacagctatcatcaggaaaggcacagcacaggaaaagaagtgctgcacaatatcaaaacgcagatcaagctcatggattttaccgagtcggggatggcattaagagaaacgatgaccgctttgctggattttcaggagtccaaccgtttattggcgggaaaagtatccgcgcttgatctgcattatgaaccggatgcggagctgccgccgcatacgctgaacggaaaacgcctgccggatatcgaactgacccttcatgacgggcggccggcccagctctatgattttctccgcgagggcggctttgtgcttctgtcattaagagggagcattcccgccggtattgatacggaaagcgtggcagcagtcagggcggagcttgctgaaacacgtgccgattggaacgacgtccacaccgttttaatccggccggacggccatgcggcatgggcagccggcggctcgggacgtgaagcggaagaagccgttctggccggtttggagagatggggattattcatctgataacctttttatgcgtctgtgtgattgtttcttgtgtaacaaaacgttatagtaaaagaaacaatcaatacggaggggtgactcagcagttggacagaagacagccagaccatgcaaaacacatgattcttgaagggctgacagatatttttcacgagcaggagaggtgccaggaggatatcagggcgtcgttggccggacggatggatgaactccgtgaagaaaatgggaaaaagttacaattgaccttgacggaaattcacattttgtcgtgtatcggagatcatgaaccgatcaatgtcacgtcaatagcggaaaaaatgaagacgacaaagccgaccgtgtcgagaagctgcgcgaagtttttggaagccggcttcctgcgcagaacccggctgagtgacaataaaaaagaagtctatttccggctgactcctgccgggaaagagctgcattcccttcatcatgaatatcatgaattgataaaaaagcggctcttggcgtttttagaccgctatacagatgaagaactgttatttgctgaacggctgttccgtgatctttcagcaaactggcggtctgtaaatggcggcggagagctgttcaaataaaaaacacgcatatggatgcgtgtttttttattcggatcatgttcctctttctgcccggcctctttcgccgtgtgcccgtttcagctgagaaaggtggtgcagcagccgatagaagggcggaagcatggcgatgacgagaacgatccggatgacctgaaccgcgacgacgaaagtcgagtcttcgtgcagggtaatcgaagtcgccgccatctcggcgatcccgccgggagaaaaggcgagaacagatgtaatcatggagatgcccgttaatttagaaaccgcaaccgcgctcagaatcatggcggcgattaatccgacggaagaaataaacccgacggtcagcactctcgtcacgccggtgaacatgcttttgtacatttttgatccgattgtggcgccgagaaaaatttgtgacagctggttcgcttccggcggccaccaggccagcatgtctttgcccgccaaggcggacacgccgatttccgcagcagcaacgccgatcatgctgccgagcagccaaggggcgggaaatttcagccgttttgcgcctttacttgcaagccaggcagccaaaataaatccggccgttaacaagacgggagtaaggcccggatgtgaagctcctgccgaaacggctccggctgatgtctgagccgcaccgttttgtttggtaaataagaaaatgacgagaaacggtattgtcatgacgaccaaaaggacgcgcgtcagctgaataaggcttacaatcgcggtgtttgcgccgacttcctgggcgataccgggcatggcggataaaccacccggcgccgtgcctacaaagcttgtcatcatgtccgtccggctgaaccgaaagagcacatatccggaaacaagcgccatcacgatagagaaaatcagcatgaagcctaccggaagccaatgctcccgtaaaaccgacagaacggacaggttcagtttctggccgagttcgatgccgaggatcatttgtcccgccgcaagccatctgcggtgaatccctcttctgtcaggcgccatgaacagccagcggggcctcgtcatggagaggatgcagccggcggcaagcgttccgagcatccaggcgatcgacatccctgtgagcgaaagaagaaacccccctgccgcactgatgagaataaaccagatatccgtaaggagatgtttgtctttcttcaatgaaaacccttcttcctgaaacattcatattaaattgttaagctcgttaaccttactattactatagtatagattttgagataaataaataatgaattatttctcataatccattcatttttcttatcgaaaacacaaaaaaagctccggagatgggtgagtgcaccctactccgaaacctcgcccgcttttcctttccacacaagcgtcaatcccagaccgagaaataaaaccacacctgcgaacagaaacgggaagtgaatattcatatcaaataaaataccgcccagagccgggccgaaaatggtgcccaaactcgtgtatgttgagttcataccggcaacaaacccctgctgatttcctgcgatcttcgatagataagtagtcagtgccgggcgcagtaaatcaaacgcaaggaaaatgatgcaggtgacagcgagcacgggcaaaaaccctgacatcagcgtagaaacgaaagccagcacagcgccgatgatcagacaaagctgaatgacttttttctccccgaggaagttgacaagtctgccgaacgcgagcacttgaatgaggactgccacaatggagctgaacgtaataataatggcgatatcctttggcgtgaagccgaatttatggtttgtaaataagctgaataccgtttcgtacgccgacagcccgaatgccaaaacaaagacgatgataaaggcgatcaagtagcttgggtgaatcgactttttcaaatcttttaagaaggttgattctttggcgctttccatctgctttgcacgttcttctttagttaacggctctttcagcataaagacagaggaaatcactgcgataaatgcaattcccgccgcaaagaaaaacggcatacgaacgccgtgatcggcaataaatcctcctatgccgggcccgatgataaaccctgtgctgatggcggcagatacatagcccatcgccttcgatctttcctgcaccgtcgtaatatctgcgacatacgctgtaacagcgggcatgataaaagcggcactgatgccccccagcacccttgcgaaatataaaatggagacatgtgtgcccaatccgaaggtcagttcggataatgcgaataaaaacagtccggcgagaatcatgatttttctgccgaagcggtcaacccatctccccgcaatgggggatgcaattaattgcgcgacggcgaaggcagcgacaaggtatcccattgtgctgcccgtcaagtgcatcacattcataaacagcggcataacgggaatgatcaatccgatgcctaaaaacgcaataaatatgttgcttaataagatgatgagtacagccttttgttctctgatcggtttttgcatgttgtttctcctttgtcagctgtcattctgtttatcagcgttgatcgacccgtgaataaacacggagatggcttctttttgcaattcgattctttgctgaatggtatcgtttttatataacacatctaaaccgtagaagacggatagcaggatttttacttttgattcgacatgaggaatggaccagctgccgtcttgatttccctcttctaagatctctctcatcacatcgtcatattcaatatcaattttgttgagccgctttacgacctcctctgacgtaaacgcactcgcataaaactcttcacttgctctcataagcgggtaattgatgctcatccggctcagcagctccgcaaagcccgtcagcttttcggcagcatctttcagatcggattccatttccctccacgtctcgatcatcacgcggtgatcctcttccatgatatgaagaaacagaaactcttttcctttaaaatggtgatatagattgcctttactgatctcggccgcctctaaaatatcccgaatcgatgtttctgaatatcctttttttgcaaataagtcacgcgaagcggatacgagcctgttcttcgtcttttcgctctttcctgcaccgccttttgtatttgtcacttcacacagatcctttccgcctcattcatatcgttgtcccggcaaagcgggttcgggtcgtttaaaaccgaccagttggtttattttattataaagggtttttgctgactatacaatgaagaagttatccattgtttagtggaagtataaaaacggctcgaaaaataaaccccattctctcctgttgaaagaacggggtttgtcagccgtctgaagactcccggcgggggagcgtgatctgcctgaatcgttattttccggtatttacctcggtgtagcttgtgttcggcgcgtttgataccgttccccctgtatggtggaaaggagagtgggcagagtgggccatatcgtataaaaaccagacggcatgacgctgctcgtcaaatgccgtgcgggcaaataaccgtttcgcttccggatgcaccgctctatcggatgcctgcaaataaaaatcattcgttttctgctcatcataaaacgccgccctcagtccttctctgtatgtgtgcggacaatgctccgtctgtttcggcgtcaactgttttccggtaattgacgtatacagtgaagagaaagcgtgcatgtggcgcacttcttcctctctgatatgttcgattcgtcttctgatttctgcggtcggcgctttttcggctaatattgagtagcaaatcacagcgctgtattcaccgtttatggattttaccagatcctttataagcacagaatcgtcactgcagatggctgtataatgaaaaaaattctcgtgcattggactcacccccggatgtttatagggtattatacggcggcagcccgtgacatgtgcggatgtcatttttattcttgatccagcggcgatgtaatatggtcgtcgtatgtgtcgacaaaaagccggccgttgcttccgcgcacagcgtatacaacgtcttccggtttgaggtttctcttgtccaattcttctctcagccatttttccgatacgtggttttcttccagatttttcatcaccagccggccgtccataatcagctcaacggcaaagttcttttcatgtccggcaaagatgccgagatcctgtcttgtaacgggcgcaaattccggtttgacctccactgacatgctgccgtttgtttcaatgatggcagtctgaacctgagaaatgtcaaatacatcattttcacgaagctgctggttcaagtagtcgagggtataacgcatcgttttcatattatgctcaagtatttttccgttttgaatgataatggtcggtttgcccgcaaagaaacccctggcggttctgtttttcatagaaagatatgcgacgagataaataatgaccacgaaaatcgtgtaagcactgacagtaaaatgaatcggcagttttgtattaaacgacagattggctgtgatggcgccgagggagatggccgcaatgaaatcaaaaagcgtcatctgtgaaatggtttgttttccgagtatccgggcgccgataaacaaaatgctgaacgacagaatcgttcgcacaatcacttcgggatattctgtcatcatatttaatcctttttttctttaatttggtcaaaaacgatatgttttaaaacagtcatcccgtttttaccagcagatgagattggtcattttcgtcaactttcgataaaatgtagaaagataaaaagagaggggtcttctaatttgggtgttgagtttttagtaggcagatcggggagtgggaaaacgaggctgattatcgacagcattcaagatgaactgcgccgggagccgttcgggaaaccgatcatttttctagtcccggatcaaatgacgtttttaatggaatatgagcttgctaaaacgccggatatcggcggcatgatacgcgctcaagtgttcagtttttcgcgtttggcgtggcgcgtgcttcagcataccgggggcatgaaccgtccttttgtgacgacgacgggtgtgcagatgcttttaaggaaactgattgaagaacataagcacgagtttaaagtgtatcaaaaagcgagtgacaaagccggattcactgagcaggtggaacggatgctgacagagtttaagcgatactgtattgagcctgaagacgtccgccgcatggcggaaagcggaacggcgtcagaatatcgcggagagcggatgctgtctgaaaaacttcatgatttagggattttatatcagcagatggaaagaagcctcgccggacactatttgcattcagaggactatttgacgctgctcgctcagcagattcctttggcggacgttgtaaaaggcgcccgtgtttacgtcgacggattctatcaatttacgccgcaggaattaagggtgctggagcagctgatcatgcatgctgaacatgtcacattctcgctgacggcggacagcccttcggcggaacaggcaccggatgagctcgatctgttcagaatgacgggaagcacatactataagctttatcagacggcaaaggaattgaatgccgatatttcctgcaaggaactgcatggcacgaagcggcatcggcatgtgccggagcttgcctgtatagagtcgcagtacgatgtgcgtcccgccgcggcgtataccggcggacaggaagcttttaccgtcatgcaggcgcaaaacagaagagctgagctcgaaggtattgcccgggaaattcaatcgcttgtccgggacggaggataccggtacaaagatatggcgattctcatccgtcagccggaagattataaagatttgctgaaggaagtgtttgccgattacgggcttccttattttattgacggaaaagcttctatgcagcatcacccgcttattgaattcatccgttcaagcctggatgtcgtgaaggggaactggagatatgaagcggtgttccgctgtgcgaaaaccgaactgttattcccgcttgatcagccggagcagaaaataagagagcaggttgatcagcttgaaaattactgtatcgcctacggcattaaaggggagcgctggacgaacggcgagcggtttgtatacaggcgcttcgtatcgctcgatgaggatttcgcgcagacggatcaggaaatcgagatggaacacatgctgaatgagacgagagagtggatagctgcaccccttgtccggctgcagaaccggatgaaaaaagcgaaaacggttcaaagtatggcggaggctctttatctctttttggaagataccgatgttcccctgaagctggaccggaaaaggcagcgggccgaagaggccggaaacatgatcgaagcgcagcagcacggccaggcgtgggatgccgttatccagcttctcgaggagtttgccggcatgatgggtgaagatgaaatatctttagcgctgttccagcaaatgcttgaaacgggaacggaatcgcttcatttttctttaattcctcctgcgcttgaccaagtatttgtagggaatatggatctctcaagaatatacggcacgtcctgcacattcgtcatcggggccaatgacggcgttcttccggcgcgcccggatgaaaacggcgtgctgtctgatgatgaccgggagtggctgaaagcagtcggagtggagctgtcttccgcggggcgtgagcggctgcttgatgagcattttctcatctatatggcgctgtcgagtccgtctgaccgtctctatgtgtcatacccgattgccgatgcggaaggaaaaacgctcctgccgtcaatcgttgtaaacaggcttggcgagctgtttcccgatcatcaggaaaagctgtcagcggctgatcccgagcaggtaagcgaagaagagcagcttcagtatctcgtcaataaacaggtggctcagacgtatacggcaagtcagctcaggctgtggacaagagagtacgagatcagtgacgtatggtggagcgcatacaatgtgctgatgaaagagtctgatcaccggcgtgcgaaaaagctgttttcaagcctgtttttccgcaatgaggcgaagcgtcttgaacggcctgtttcgcgccagctttacggcgagcatattaaaggaagcgtctcccggatggaggcgtttaatgcctgccagttttcccattttgcctctcacgggctgcaattaaaagagcggcagtttttcaagctggaagcgccggatatcggccagctgtttcactccagtctgaagctgatttcagaccggcttcgtgagcagaagctggaatggcgcgatctgacgaaagatcagtgccggaatttctcctatgaagcggtggaacggcttgcgccaaagctgcaaaaagagattctgctcagctcaaacagacacttctatgtgaaggaaaaactgcagaagatcgtcacgcgtgtttctggcatattaagcgagcatgcaaaggcgagcggtttcgtcccggtcggtcttgaactcggctttggcggaagcggaccgctgcctccgctcactttcacgctgaaaaacggctgtacgatggaactcgtcggacggatcgaccgcgtggataaagcggaaagttcaaaaggcctgctgctgagaatcgttgattataaatcaagcgacagggggcttgatctggctgaggtgtattacgggctcgctctgcaaatgctcacatatcttgacttatcgattacacattccgcggattggctcggcatgaaagcgaccccggcaggcgttttgtatttccatatccatgatccgatgattcaggccagtctgccgatggggcttgatgaaatcgagcaggaaatttttaagaaatttaaaatgaaaggccttctcctcggtgaccgggaggcgatcagcctgatggacacgactttggaggaagggcgttcaaatatcgtcaatgccggtttgaaaaaggacgggtctttaagatccgactcagcggcggtcagcgaacaggactttcatctgctgacagaccatgtgcggcggacatttgaacaggcgggcgaagcgataacggacggacttgtgtccattaccccgtataagctgaaagataagacgccttgtacgtactgtgcgtttaaatcggtgtgccagtttgatgagtcgcttaaggaaaatgaataccgcagcctgaaagcggaaaaagacggcaccatactggattggctgaaaaaggaggcggatgatgatgcaaattcctaaaccgaaagacagcatatggacggatgaccaatggagcgccatcgtttcttcgggccgcgatattcttgtcgctgccgcagccggatcaggtaaaacggccgtgctcgtggaacggatgatcagaaagataaccgcggaggaagatccggttgatgttgacaggctccttgtggtgacctttacaaacgcctcagcagcggagatgaagcatcggatcgctgaagcattagaaaaagagctcgccaaaaatccgggatctctgcatatcagacggcagctctctctattaaaccgggcgagcatttcgacgcttcactctttctgtctgcaagtgcttaaaaaatattattatatgattgatcttgacccaggttttcgcatggctgaccagacggaaggcgaattgctcggagacgaagtgcttgatgagctgtttgaagatgaatacgcaaaagggaatcaggcgttttttgagcttgcggacagatatacgacagacaggcatgatctggatcttcaagaccttgtcaaacgggtgtacgagtattcccgatcgcatcctgacccggaagcgtggctgcagagctttgtccgcttgtatgacgtgacggaagaaagcaaaatggaagagcttccgttttaccagtatgtgagagaagatgcggaaatggcgctcttcggggcaaaacaaaagcttgagaaggcgcttgaactgacaaaagcgcccggcgggccggccccgcgcgctggtgattttctggatgaccttcagcagatagaagagctgatcagctgccggcatgacttcgatgcgctgtatgaacgggtccccgcagtctcatttaagcgggcgaagccggtaaagggtgatgaatttgacaaagcgcttttggacgaagcgaccgatttgcgaaacggcgcgaagaaactgatcgaaaagttaaagaccgattactttacaagaagtccgcaagatcacttgaagagtttaacagatatgaagcctgtcatcgaaacgctcgttcagctcgtgatatcgtacggaaaacgatttgaagcggcgaaacaagaaaaatcaattattgatttctcagatttggaacattactgcctggcgattctaactgcggttgatgaagaaggccggcgggtgccgagcgaagcggccgtttattatcaagaccagtttcatgaagttctggttgatgaatatcaagataccaatcttgtgcaggagtctatcctgcagcttgtgaaaagcggggatgaacaggcgggaaatctgtttatggtaggcgacgtcaaacaatcgatctaccgtttcagacttgctgagccgctgctgtttctcgggaaatataaaaggttcacagaaagcggggaaggcgcggggcagaaaattgacctgaaccaaaatttccgcagccgttccgatattttggacagtacgaatttcttgtttaagcagctgatgggcggaaaaatcggcgaagtggactacgatgaacaggcggcattgaagctcggcgcatcgtatccgccgaatgacgcggcaaaaacggaactgctgctgattgacagcgctgatgacgcaagcagctccgaggatgccgaagactttgaaaccgtgcattgggaagcgaaagcgatagccggggagatccgaaagcttgtctcatctccgtttaaggtctatgacgggaaaacaaaaacacaccggaatatccagtaccgggatatcgtgattttgctgcgctccatgccgtgggcgccgcaattaatggaagagctgaaaaaccagggcattccggtgtacgccaatttgacgtcgggttactttgaagccgtggaggtggctgcggcgctttcagtcttgaaggtgattgataatccgtatcaggatattccgcttgcttccgtgctgcgctcgcccatcgtcggctgtgacgaaaatgaacttgcgctgatacgccttgaaaagaaaaaagcgccgttttatgaagcgctgaaagcatatatagcgaacggtgacaggcatgatgaactgtatcaaaaactgagaaccttttatgacagtctgcaaaagtggcggtcattttcgacgaatcattcggtgtctgagctgatttgggaagtataccgcgataccggatattttgactatgcaggcggcatgcccggcggaaagcagcgccaggccaatctgcgcgtcttgtatgaccgggcgcgctcgtacgaagcgacggcgttccgcgggttattccgctttttgcggtttattgaacggatgcaggagcgcggcgatgatctggggaccgcccgtgcgctcagcgagcaggaggatgtcgtgcggctgatgacgatccacagcagcaaaggacttgaatttcccgtcgttttcaccgccggactcggcagaagttttaatatgatggatctcaacaaatcatacctgcttgataaagagctcggtttcggcacgaagtatattcatccggaactcagaatcagctatccgactcttccgcttgtggcgatgaagaaaaagatgcgcagagagctcttatccgaagaattgcgcgtattgtatgtggcgctgaccagagcgaaggaaaagctgtttctcgtcggttcctgcaaaaaccgggaaaaacagctggccaaatggcaggcccaagcagaccgggctgattggcttctttctgaattcgaccgctatcaggcgtcatcttatttggactttatcgggccggcgctcatccgccaccgtgacatggaggcgcacaggacgccgggactttcttcgactgaggatatcttgcgcgacccgtcgcgttttcacatccggatgcttcagcaaagtgaattgctggaagagaatccaaaagaacgtgctgaagaaaagagcaaacgtctcgaggcgatacagcagggcgagccgattcctggttcgttttcatttgatgatcaggcgcgccgtctgcttgaatgggaatatccgtaccgagagctgacggctatcagaacgaagcagtcagtttctgagctgaagagaaagcaagagtacgaggatgaatacagcggccgctctctcatcaaaccgtcaggagacacgcttttatacaggcgtcccggttttatgatgaaaaaagggctgacagccgccgaaaaagggacggcgatgcatacggtgatgcagcacataccgctgacgcacgttccgactgccgaagaagcagagcggacggtccggatgctttacgaaaaagagctgctgacagaagagcagcaggaagccattgatatagaagaaattgtccggtttttcggaactgaaatcggtaaagaccttctcggagcgctgcggattgaccgggaagtgccgttcagtatggcgcttccggccggcgaggtgtacaaggatgccgaaacggccggtgaaccgctgctcgtgcaagggattattgactgcctctacgaaactgcggacggtctctatttgctggactataaaacagatcggatagaggggaaattccggaacggatttgaaggcgcggctccgattctgcaaaaaagatatgaaacacaaatcgaattgtatacaaaagcggttgaacaaattacaaaaacgaaagtgaaagggcgtgcgctctatttcttcgatggaggtcacgttcttacactgtaacgagatccgaagctcctttttggagcggatctttttttctatcaaaaagtgaggtgaatgcggtatgcgcattttacatacagctgactggcacctcggcaaaacgctggaaggcagaagccggctgagcgagcaggccgaagtactggaagagctgaataccattgtcaaggaagaaaacattgatgcggtcattatggcaggagatgtattcgatacggtcaacccgcctgcgctcgctgaacaattgtattacgaaagtctttccgcgctttctgacggcggaaaacgcccggttgtcgtcattgccggaaaccatgacaatcccgacaggctggcggcggcttctccgttaacaaatgagcgcggcattcatttaatcggctatccgcggacagaacccgtccatattgaggtgccgtcggcggacgagctgttagccgtagccgcgctggcatatccgtcagaggcgagattaaacgaagtgctttctgatacgtttgaggaaaagcttcttcgcgatcattacgatgtgaaaatcagagaggcgtttgctcacatgtgcgggctgtgccggaacgatgccgtgaaaatcgcggcgagccacatttatgtcgcggggggaaatcagaccgattcagagcgcccgattgaagtcgggggcgcttacacggtcgccgctgacagcctgccggctgatgcggcttacgtggctctcggccatctccaccgtccgcaaacgatcaagcgcgccaagacggctgcccgttattcaggctctccgctcgcatacagcttttcggaagccggttatgccaaatcggtgacagtggtagaagcgaagcccggcggagaagcgaagtgggaagagattttcctgtcttccggtaaaccgctcgtcaaatggaaagcgcaggggctgagcgaggttcacggctggcttgatgaagggcgtgaccggaatgcctggatcgatcttgatatccatttgacggatcagctttctctcgaggaaattcatcggctgagaaaggcgcatcccggctttatccatatcaggccggtttttgaagaaaaagagaccgaaaatgaccggattgaagtgaaacacacatcaattgaggatcgatttaagaagttttatgaaaaacaaacgggcggcggcgtgccggatgaggagatggtcaagctgtttttagagcttgcgtcagcagatgatgaggaggatgcgacatgaagccgattctgttaacgataaaagggctccacagcttcagggaggaacagaccattgattttgccggactgtcaggagccggggtgttcgggattttcgggccgaccggaagcggaaaatcgtcgatccttgatgccatgacactcgctttatacggaaaagtggagcgcgccgcaaataatacgcacggcattctgaatcatgccgaagatcagcttgccgtctcatttacattcgcgcttcaatccggccaccgggtttcctacaaggtcgagcgcgtttttaagagaacggatgaaacgaaagtaaaaaccgccctctgccggctgattgaaatcaaagacgaacaaacggtgctggccgataaagcgaatgaagtgaacaaaaaggtagaggagcttcttggcctgaccattgacgactttacaagagccgtcgttctgccgcaaggaaagtttgccgagtttctgtcgcttaaaggcgcggaaagaagacatatgctccagcgcctgtttaatctggaacagtacggggacaggcttgtcaaaaaattgcggcggcgggcgcaggaagcggcagcgaaaaaaaatgaaatgctggccgaacaatccggcctcggagacgcaggagaagatgcgctgaagcaggctgaacagcagtttcacgaagcgaacgaacggcttgaagcagctgagaagaaacgggtccgggcaaaagagcgttttgaaaatcaccaggaaatttggaacttgcagacagaaagagatgaatatgagcgccgggagaaaaagctcgaggaaagacgcccgtacatcacggatttgactgagcgtcttaaagaggcggaaacagctctcgcccttgagccgtacgcagaccgctgcaccgaagccgtccgccggaagcagcgcgccgaacaggaacacgaactggccaaacggaaatcagaggcggaaaccgtttcatttacccggcaaaatgaagcctatgaagcatggcgcgcccataaggccgaacaggagccgaaacttgtcaaggaagaagagctgtatcaaagactttcagccattgaacaaaaactgcttgaagcgaaaaaagaagcggaaaaaacaaatgcggagcacagcaaaaaagaggaagaatacgaagccgcctcgaaacagctggccgcagtgaaagaccgcctgacccgcggccaaaacaggcagaatgagctgaaagaagagctgaaagcagttcaagtgaccgccgatgaacggaaaaaatgccagaccgcagcacagctggcggcgggctttcagcagacacaggaacaaatcacgaaagagcgggccaatctgacaacgcagctgaaaaacgtggagaagctcaacggagaaagcgagtcgctcacagcgaaagcgaaaacggaagaggaagacattacgcgcgcttatcaaacgctgcaaaccgtttaccatatggtctgtgaaacggaacgttcactgaaagccgcagccgaacgggctgaaaaaacgcaagccgatctccgcaggcgctcagaggaagcgagaacggctgcattaacaaaagaattatcggaaaaactgatcgtaggaaagccttgtcctgtatgcggctcgacgcagcatgaccgcccgcgttccgctcatgaaacattctcgcctgataccgctgtgcaggaacatttgcagcaggtggaagcactgctttctgaggcggcggctctttctcaggaagtgctgacagccaaggttgcattagaagaacagtcggggcgttttaccgaagaatgtccgtttctgcaaagcgcccgggttccggagctggaagccgcttcttccatcagcggacgcccgcttgatgaagcgttcagcgccgtccgcttggaatggaaacaaatgaaacaggatatgctgtcggtaaaagagaaggtcacaagactgatcagcgcgcatcagcagacggtaaaacaagctgagcagcttgccgaacgaatccgctacgaggaaaaagaagccggccgtctcagacattcattagaagagcttgaatcgctgtcagaaagccgattgaatcagtacaacgaagtctgcggtgatattccgccaaaccggattgacgcctggcaggcttcgatagatgagaaggacaggcaggcagaagaatgtgagaagcgcattgaaacaagcatcgcattcctcaaggaacatgaagaggagaaagaacgcctgcaggagatgaagcatcggcttgaacgggaacggctcgagcttcactatgcgtctgagcgcctgcagcaggtgattgacggatatgaacaagagctcggaacagcagctgaagaaacatcaatttccgcaaagcttgaagcggtgcggcaggaattacagctgttaaaatcaaaagaacagtccctattcgatgcgctgaagcaggcgcagcaatcgctgaatgacgcaaaaggccgggaatcagggagtctcatgtcactcagggatgctgaggcctctcttgagaaagcgcaaaacgactggcgcgtgaggtcaaaagacaccgggtttaccgaaccggaccaagttaaaaaaagtctgcttccgcaagggcgtgcagaggaaatgaaaaaagaaattgatgagtttctggacacctccaaacagctatcggcaaatatcagccgtgttactgataaattagccgagcgccggatatcggaggaagaatggacagcatcggtttctctgctgaagcatgcagaggctgagtcaggcgccgccatggaggaaaaaggagcacaggcaaaagcctacgcggttatgcaaaaacagcataagcgctttaaagaaattgaagccgagctgaaaagctggcagacacagattgacaggcttgataagctccagtctgtatgtaaaggcaatacattcgtcgaatttttagcggaagaacagctggaaagcgtggctcgggacgcctctgcccgtctcggagcgctgacaaggcagcggtatgccatattagtcgattcagaaggcggtttcgtcatgcgtgatgacgcgaacggaggcgtcaaacggcccgtatcaagcctttccggcggggagacgtttctgacatcgctgtcgcttgcgcttgccttgtccgcccagattcagctgcgggggcaatacccgctgcaattctttttcttagatgaaggattcgggactcttgaccaagggctcttagacaccgttgtcacagcgctcgaaaagctgcaatcggacaacttatccgtcggagtgatcagccatgtgcaggagctgagagcgcgtctgccgaaaaaattaatcgttcatccgtccgaaccgggcgggaaaggcacccgggtcacattggagatcatgtagaaaggagaaggaattatggccgattctgccgagggcacatgtgaattatgcggccgccatcatgtgcggctgacggagcaccacttaacgcctaaggaagaaggcgggacattccttccgaccgcaatgctctgcatcccttgtcataaacagattcacgcgctctatacgaatcaggagcttgcggcaaggctcgcgggaatagaagagctgcggcgtgacccgaaactcgcgcggtttgtgaaatggatcagaaaacagccgccggaaaagcttgtaaaaacaaaaaaagcaaatgaacgaaaataacgctgaaccaaaagcagccctcttctgaaagagcggctgctttttaggcgtttccgaccacattttgatcgctgacatcggggtctatatagtttgtcgcattgacaacgttgtttaataacaggaaatctccggtattgcctgctcccgaaccgagcgcagatttagaagagctttttggagaaaggtaaaaggaatcaccaaagtttacgactccgcccgatatggaattgatagctataggtccggtaattgctggcataaacgacaccctttatagaagtctcaccgtcattatatgtcagggctgctgtgattgtgagcttggcgtgaagatctgcctaatatgtttcagccgcgaatctcccagaacgatcgacgtcgatccgatttgaaccacggacgctgacgataccccttgaattttcacattccttacccgaattgaagggttttcatggcagaatgcgctttggactcccgtttccggtaacggcatgacggccggctgccgaaagatctggtattcttttttgttaaatgagccttcatcatctctgtatacagcaagactacgctgatcggccaatactttgatccgcatattgatttcattcgtatcgcctgcttgaaagacactcgcaatcccgactgaattgattttggcgttccggaggcgtgaaatgcgctttaacattattccggcgccagcggcacataaggcccgataataagagattccggaggcgtgtcaaagatggaagacagatagacggaatcggtgtcgccgattaataataaggaagaactggatacaccggtagaccggatgtcgccgacttcaatgttccggttaatcactgtaaaaatcatgacggatcatcacctttcatttcaccaggtatgtgtttaataaagtgctcgacggccctgacaatatcacgcttcacatgttcggcaatctgctcggcatattgcgcgggcgccgtattttcttctttcgggacatgggacagataatactgaatccggctgtccatctgctttctgatatcttcaataatatgatatttgttcgcttcgtccagcctgctctcatactgagtttcgagctgctctaaaagcgcggggatttcttcattcaggtacatatcgacgttttgacggatttgctgcatttgctggcccgcctgttcctgctgcatcattccgacctgcggagatgtctggccgacttcgaagttttgcacggcattcggatcagtcggattcaatccgatattcagcgttccttccagccgttcaattttcagctgatcaaatttatactcgagccgatcaattcttgtagaaggctgctgcttcagcgttgaaatttcattttggaattctttcagctgccgttcgagctcctgaatctgctgcgcctgctgctggacgaaagaatttaaattctgcaggtaggatgaaacggattgatcatacatgacattcacctcgcgtctcgtttccttcattaaaactaccggcttggcggctggagcggtacaaatgatgaggtgccgggacctccccctgttgttacagcctgctgccccgcggtgacaggcggcgccggctcaacataactccctgtgttgtacagattggaaagagatttaattgaaccggcgcttccgatttgcagtatggaggaattgctgacagattctacacgcatgtaattgatatggatcgactgattgacgtaaaaattcatacggcgcctcctttatgcgtttcctgccatcggctgatcgattacatcattatcgtacacattcgttgaattcctgtaattcgtcagtgtgagattgtctccggtattgaagctgcccgctccggcaaatgtcttaacctctgcttttggagaaatggtgatgcagtcgccaatatgaacgactccgctcgtaccgacggcattaattttaaacgctccgacaattgcgggcatacgagcacatccttttcgtgaagattttcatgactgcactccaggagcttatctgggctgcctgcctaaaatagcttatgacaaatgcacatttttgtgagcggaaaaaactttagacgtaaaaaacaccggcgctttacacatgccgggtcttatacataaatgatacagatttatatacatatcacgtttatgagaaagcctcttttctttcgcggccgtgctgaatctgtgcggccgggttcgtcccgctgtctttcgtttgttggatgagcccgccccggcacccgtttaaaaggctgtccagctcctggctgcacctgatggtctccgtcgcattgattccgaatttttgcgctgtctcgaataaagttaatcttttttcttcaattttgttcatcgtgtgatctccaattctcgattattttggaaaacataggatgataatagtataacccattttggccaagaaggttttatttcgtcaatatgactaaaaaagtgacaatttttgatactcttttacacttattttcagcctgtttaaaagagggatttcccgttcggaggaagaatacataaaggaatgccatttaaaaatgatgggggattaacatgaaatttgcgacaggggaactgaacagccgaaaatttgtcggtctgattattgatgatgacaaaatcttagatctgcaaaaggctgaaaaaaaattgtttgaacttgagacgattccgggttcgctgatcgagtgcattcaaaaaggagataagtttgtcgcgcatgccggacagcttgcggaatgggcgaaaaaaccgaatgacgagtcgggttcatttatgtatgcgctgtctgacgtaacgctttgcgcgcctattccgagaccttcaaagaacgtgatctgcatcgggaaaaattatcgtgatcatgccgttgaaatggggagtgaggcggatataccggagcatcccatggttttcacgaaagccccggctgccgttacaggacacggagaaacagtgaagagccacttggacgtaacggagcagcttgattatgaaggggagcttgcggtaatcatatcaaatagcggatcgcacatctccaaagaacatgcgcttgatcatatattcggctatacaattgtaaatgatatcacagcgcgcgatctgcagaaaaaacataaacagttttttatcggcaaaagcctcgatacgacatgcccgatgggcccggtcattgtacataagtcggccgtcagcgatccgcaaagcctgaaagttgaaacgcgggtgaacggtgaactgcgccaatcaggatcaacgggtgacatgatatttccgatagctgaattaatcgagacgctgtcaaaaggaatgacgcttgaagccggtgacattatagcgacggggacgccgtccggtgtcggaaaaggatttaagccgccgaaatttttaaagccgggggaccgtattgacattacaattgaaccgatcggcacgctgtcgaaccaaatcggataattgtgtgtctttcgcacgcttgataatgctccgagaggcttgttgtggtaccataagtgaggcagattgatctgatagggggaattgaacataatgacacattggcatattacttcatgggtcgttgcgcttatcctggtgtttgtcagctacgggctgtacggtgccggaaaagcgaagggcgcaaaaattacgcatatgattctgcgcttattctacattattattattctgaccggagctgagctttttgtccgttttgcgaattggaacggagagtacgccggaaaaatgctgctcggcatcattaccatcggactgatggaaatgctcgtcatccgtaagaaaaaaggcaaatcaaccggcggactgtggatcggttttattatcgtgctcgtcctgacggtgctgctcggccttcacttgccgatcggctttcacgtattttaatcaatcgcttgaaaaacccggatgcatccgggtttttttagttgcgcaactgtgccgctgaatgagaaatgccgtgacagggggatggtgatgaggcgaaggagatgtgcaggatgccaaaagcatcaatcactcttgttgccgtaaaagctacggctgtgaagggtaaaagcaaacgccggccgtcaatcagcgtgaaaaacaaagctgaatacatcaggcggcacctatttaaaaggtgccgcctgtttgttacgcggtgccgtcttgttttgccgcagaatacataatggagcgccgcccgtcagatgccgtccattcaaatctgtcgtgtttacccgagctgccgcggtgatgctgcagggcgcattgtgcgtcatccgccgagaagtgataaaacgaaacgccttcaccggaaaacagcgcctgattgtaggaaaatacgcaatcatatacagacaggccgaacccgtgcagatggctgagaaacagcagaaacgtttcatcgtccagcgaatcgagcaaggttaacagcggccgtttgaccgctttttcataacggatttcttccccgccgagcagggggatggtgtctgcgccgatttcggccgaaccgccgcaaatccgtgccggctgccatcggccgccgtgtttcatcaatacggctgcgtttcctagactgtctgcaagcaggatatcgccttcatcgttttcgacgaggcagatgccgtcctctatcatcagggtgccgcgcccccatttgtttttttctgagaaaagctgttttcgtttcataaccgtgccggtctcctttgtttgtttcttctcttccgttctttccaaatcgggcttgtctcatacaagtcttagtgggacaaatcaactatctgagtttctttgcataaactgggtaaagtgctgatagaaacgaatttgaaaccgacagaaacgggattggagctgatatcacatgtgtggaattgcgggttgggtcgattttcaaaagcagctcgtccaagagaaacatattatgaacaatatgatagacactctttcaaaacgagggcctgatgattcaaacgtctggggagagccccatgttttattcggacataaaagactttcggtcgttgacattgaaggcggccgccagccgatggcctgcacgcatcaagaggaaacgtacaccatcatttataatggcgagctgtataacacggaggaattgcggaaggagcttcaggcgaggggccaccgttttgagaggacctctgatacagaagtgctgctgcacagctatattgagtggcgggaggagtgcgtggaccgcttgaacggtattttcgcttttgccatctgggatgaaaagcgcaagcggctgttcggggcaagagaccggctcggcgtcaaaccgtttttttataaagaacacggctcttcctttctgtttgggtcggaattgaaagccatccttgctcatcctgatgtgaaagcccgcacagacagcggcggacttgcggaagtattcggactcgggccgtccagaactccgggctgcggggtgtttaaaggaattcacgaggtgcgtcccgcccatgcgttcactttctcaaaggacggtttgtccatatggcgttattggaatgtaaagagcgaaaagcatacagacagcttcgatgaaaccgccgctcacattcggtacttatttcaggatgcagtgacacgccagctcgtatctgacgtgccggtttgcacgtttttatcaggggggcttgactcgagcgcgataaccgcgatagccgccgctcattttgagaaacaaggaagagatccccttcatacttattcaattgattatgaggagaacagcaaattttttaaagcgagcgcctttcagccgaatgatgacggcccgtggatcgataaaatgacaaatgcattcggcacacagcatcataaatgcgtgattacgcaggatcagctggttgaacatctggaggaatccgttctcgtcagagacctgccgggcatggctgatgttgattcatcgctattatggttctgccgggaaattaaaaaagattttgtcgtgagtctttccggagaatgcgcggacgaaattttcggcggatatccgtggtttcacaccgcggcagaagaagacggatttccttggatgaggtcgactgaggagagggtcacgctcttggatgaaaagtggcaaaaacggctgaatcttagagaatacgtgaatgcgagatatgaagaaaccattgcggaaacgccgctgttagacggtgagacgggaacagataaagcgagacggcagctgttctacttaaatatgctttggtttatgacaaatctgctcgaccgcaaagaccgcatgagcatgggcgcaagtcttgaagtacgggtgccgttcgccgaccacagacttgtggaatacgtttggaatattccttgggaaatgaaaatgcatggcagccgggaaaaaggcattttgcggaaagcgcttgaaggactgcttcctgaagatattttgtaccgcaaaaaaagcccttatccgaaaacgcatcacccgaaatacacgcagggggttacagaatggctgaaaacgattttgcaacagaaagattccgtgcttcacaccctgcttgacagaaagaagctggaaatgctgctggagacagaaggttcatcttttcaggtgccgtggttcggccagctgatgaaaggcccgcagctgatcgcccatcttgcccagatccatacatggtttgaggcgtaccgtatcgatatagaagaataacagtgccgcgaccggtttccgctgaaggatatcggtctttttattgtgaaacatatggtacactaaaaaacagaggagtgataccatgaccgaatatgaaacatgcgcccagcttgccgaggcgcactttcctttatataaacggactttctcatccctgccgccaaaaaacaggcgggccgcatgggcggtgcttgctttgtttcacgaagctgatcggcttgatgtgcaggaacttggaggatttgaacaggcggcacaagactttctgaacggggcactcgccgacggctttttgtgggaggcgctcactgatgtgcggcagcaatttgcgcttgaagaagagccgttgcgtgagtttatcgccggccacatctctgacagagaaaaagtaacgtatcaagagtttgatgacctgctgatgtacgcgggccgaacaggcggagccatcggcctgcttctgctgccggtttgcgcgcgccggaaccaagagaaactccgccatgcagccgtttcattaggagcagccattcagctgacccgggtgcttctgggggtccatacggatgagcggtcgaaaaagcgtctcccgcgccaggtgatgatgcaattcggctatacggaagaagagctggagagccgtactgtcaacaaagcttttatgaatgtatgggagtacatcgcattcgaggctgaggcgtatttcgaggaggcgtctgaagagctggagctgtttccgttatactcaaggcccgccgttaccagtttgctggcacattaccggtcagagctcggtgacatgagaaaacggctttcgcaagcataaaaaaacgcccggcttcttaacgaagctccgggcgtttatgcaatccctttttgaatccaaatccgcgaccgccatcttctgtacataagaatgcctctgacccattcatccgcgataaatgaaatccagatgcccataagccccaatccgaaatggatgccgaacagataagcgagaggcagtccgataccccacatggaaatcatcgccatgtagacggggaattttgcatctccggcagcccgcagcgagttgatgataatgacattaaatgaacggccgggctcaagaatgatcgtcatggcgatcagcatgctcgccgtcgcaataatgtcaggactgcttgtgaaaattccgatcagctgttttgaaaacaaggtcatgatcacggatgtcaaagcggcaatgccaagcgcccagtacagacttttcatgcagcggtcataagcgtcgtcaaaccgtttggcgccgatatatctgccgatcaaaatctgtgtgccctggctgatcgccgttccgaacagcaggataaacatggtgatgttttgtgtataaacctttgttgtaagcgcctgagcgcccataatggcgataaaataagtgacaaccatttgtgaaatgttgtaagacagctgttcgccggcagacggaatcccgattttcaggagtttccgcaagtgctctttatggacgtgaaaaatcttttgccatgtcagaccgagtccgatgcgttttttgacgatcacaatcatcgcgatcagcccgatgatccgcgcaaaggacgttgacatcgcaacaccggcgacgcctaacaccggaaggccgagcggcccgaaaatgacaagaaagtttccggcaatatttaaaatattcatcccgatcgtaacgaacatcgtatccttcgtatgaccgtagctttttaaaatggcgctgaacgtcataatcaaagcctgaatgaaggacagcccgccgaccacctgcaaaaagactttggcatccggcatcaattcattggaaagacccatcacatgaagcagcggaacggccgcaaaaaatatggcggcgctgatggcgagactgatgacaaagttcgctcctattgatacataagccacttcctgcgcctcttttttctgtttagatcctaaaaactgtgaaatcacaattgtcgtacccgttgcgataaagctgaacatcacgataattaaatttaaaatctgattgctgacacccacggccgccacactgttgtcagagtattggctaagcataagagtgtcggcgtttcccataaacatatataatgaaacctcaataaatatcggccaagtcagcgcgtataatgagagtttgtgatcagaggattgtttgaatgcagcccgttttaaaatcgcttgtttcatttcttttaacccctttcctgaaaaaatcaacgtttaaaagtgtacctccattttcttataataaaaagggagagaaacgaaacttcttgcaaaaatccgacttaaaaaggagggccggaaacatgtcctttctcgagttcacagtccctccgttcccggtctttatcgctgcgggagaaggagtgttcaaaaaaggcgaaacccatgtgagacgggtcttcccggtgtttgatctgctgtatgtgaaagaaggcgtcctctacattacagaagacgaaaacgccttttccgttgaagcgggagaatacattctgctttctcccggtcttgaacattacggaacaaaaggcagtgaagaaacgacatcttattcgtggcttcattttgaaggagcggattatgaggtgacggaaaccaccgggaacaactggtcggagctgaggcgaaaaaaagggagctttgaagagccgtcccgctaccggctgtccctgccgcaaaaagggaaggtgagacgcccgcagtttatggccgggcaattcagtgtgctgacagatgacagcgccgagaactccgacctgccgctcagaaagcagattctgtttgaagagctgctgctccatcttcagaaagaagcgttccaaatcccgtccgcaaaggaaagagtcgcatgggaggccgcccggtacctgcaggagcactatcaggagaaaacaaccatcaaagcgctctcttcggctcttcattacaaccaagactacgtgacccgctgcatgcagcaggtgctcggcgtcacgcccggccagtatacgaacaaagtcagaatgacggaggcgaaacgtcttttgtccgcaaccaatgacaaaatgggggcgatcgcggacgccatcggcatggaggacccaacctatttttccaaactgtttaaacagattgaaggcatttcgccgcttgaataccgcaaattcgtaagccggaaaacggactgacctaataccagagaacagaagagggatcggtaagcatgaaaatgacaatttacgacgtggccgaaaaagcgggcgtctccatctcgaccgtctcgcgggtcatcaacaatacggggaggatcagtgacaaaacccgccggatgatgctccgtgtcatggaggagatggactatcatccgaatgttcacgcatccgctttgacgggcaaaaagacgaatatgatcggcctgatcaccccggacatttcaaacccgtttttcggggaactggcgaaaagcattgaagacagcgccggtgtacttgggtttcatatcattatctgcagcaccgattatcagcctgaaaaagaaacgaagtatttttcgatgctgcgtcagaagcaggcggacggcattatattcgcgacgggacttgatcatgatgacagcgtcacggcgcttgatgatattgtgaaatcgggcatcccgcttgcgatgattacgcaggataaaccgctcgcgccgatggacgtcgtcattatcgatgactttctcggcggctatacggcggctgagcatctcatatctttaggccatgaaagaatcgcctgtatcgtcggaaacggctcgaccacgggtgaaagagacagaatcaaaggttttcaaaaagcgatgcgggaagcggggatgacactagatgaatcgctgatcataccgacggaatattcgctggaaagcggaaaacaggcagcgggcgagctgtttgacagagaccttccgaccgccgttttcgcctttaatgatgtcttgtcatgcgcggcgatacaggcggcgcgctcccggggcattcgggtgccggaagacttgtccgtcatcggctttgacaataccattctcgctgaaatgacggcaccgccgctcacgacgatttctcagcccatccgcgaaatggggcggcgtgtcgttgaacttctcattgatgagattcaagggaagaaaaaaacaaaaagcaaaatcattttatctccggaactcgtcatcaggcattctacggcaccggtaaaaacgcgccctcagcgataagggcgttttttctgtgaaaaacattgtcaaacgagcgaaaagcattgtaaaattaaaacagcttttgggaaagcgcttgcgcaaatactacggattgcaagcaaagaaagccaacagcttgagttataaataaaacgctttcaaaataataatttctgtttaataagggaaaccgcttgctcaattacggcatgcggcctcaagaaaaaaggagcggtgatagatgacagatcaagtcagatgtgcggtgctgggattaggacgattagggtattttcatgcgaagcatttagccggcgaagtgcggggagccgaacttgcggccgtctgtgacccgatgaaggggaaggcggaagcgtgtgcgaaagaattaggaatcgccaaatggacggagagcccgtatgaactgctggaagatcacacgattgacgccgtcatcattgtcacgccgacaagcacacatgcggaaatgatcatgaaggctgctgaaaacggcaagcacatctttgttgaaaagccgctcaccctgagtcttgaggaatcgattaaagtcatgaaaaaaatcgaagaaacggacgtcatctgccaggtcggttttatgaggcggtttgatccggcatacgctgacgcgaaaagaagaatcgacgccggggaaatcggcagacccatttattataaaggatttacaagagatcaaggcgcaccgcccgcggaatttatcaaacatagcggagggcttttcattgactgctcgattcatgattacgacatcgcaagatatctcatgaatgctgaggttacgtccgtgagcgggcacgggagggttttaaagcacccattcatggaggagtgcggcgatgtcgatcaggcaataacgtatcttgagtttgattcaggcgcggccggcgatgtggaggcaagccgaaattctccgtacggccatgacatccgcgccgaaataatcgggacggcgggaagcattttagtcggcacgctgcggaacagccatgtcaccattttaacggagtcaggcagcagctacgaaattattccggattttcaagcccgctttaaagacgcttaccgtctggagcttgagcactttgccgaatgtgtgaaaaaaggggaaacgccgattgtgacagacatcgatgccgcgattaacttagaaatcgggatcgccgcgacggaatcttttaaaaccggaaggcctgtaaagcttaccccgggcgcccccaactatgccggattatgatagattcgaagtgaaaaagcaaaggcacaggaggcctttgcttttttatgattcgtatgagaataaaatgtagtcagtcggcacgcctttatagcccatttggtgaagcatcgcgcttatattgccgcgatggtatgtgccgtgattcacaatatgccggatcacatcggcatatgtcgtccggagcgttcccatgcgcggatgagaaatggagatcggaccttccgtgttctccaagtctcttaaaaattcgctgtattctttgtccagttcagtcattctatgttcaaccgcctcaaaatctccgtcaagcttttcaaattgatcaaattgcgagacgatttgttcgtaagtttctccgtaaagcacgtgaagccaaatgtaatccgcccggtatatatgcacaagcacggcgttcacagtcggaaaaacactatccagtttctgctgtaagcttgccgcgggcagggtcttcagatgctgaataacttgctcatttgcccatctgtggtagtgatacagctttaaaatgtctgacattccaattccccctcttccttccggtacattcaacatgacctggccgaattccttttatcgaaacaaaagcgccgcaaaataaaaagcagcaccccacatcaccaatgccgagcattgattcaggatgccgaggagccggccgcctgtatccgccgtttggacgagccgtcccgcgaatgccagtccggcgaaccatacccaggaaaccatgatacaagcaccggcaaacagccatttatcaattcccggataggcggcggagcttgtgccgatgacactgacagtatccaaaatcgcatgcgggttcaaaagggataccatggcggccgtgaccgcctgtttttttgccgtgaaaactgtttttttcgcctgttcggcctgcggtttgcttctccaagtctgccagcctaaaaaactgagaaacaaaaagccgcctataagcatgacggtctgaaaaacgggaatctctgcaataatcattgacacgcctgcgacggccgcgctgatgagaatcgtatcgcataccgccgcggcaatcactgcgggaaacgcctgccacacatgtttttgccaggctccctgctgaaaaataaacacgttttgcgcgcccaatggcaaaataaggccgaaagcgagcatcactccgtgaagaatggcattcatatcgtaaaaccccccaatcgtcaactacatctcattgcagccgcactgtgtgctgatgtctccggccatttggctggtacttaaaccagccaaatgtataataaataaagaaggagggatgacgtatgaacagctggcgtccggatcgggagtcgcacataccgctttatctccagatcgaacagcatataaaagaaaaaatacttcatggcgaatggaccattggcacgaaaattccctcacaaagaaagctcgccgaggagcttcaggtcaaccgaagcacagtgacggcagcagttgatgagttaatcgcccaaggtcttctggaaggaaaaagagggggaggcacaaaggtcgtcaacaatacgtggagcatcatggcagcggctaagccccttgattggagcacgtacgttacatcggggagtcatcagccgaattcatccttgattcaggccattaatcaaaacgagccgcgtccggatctgatcaggctggggacgggtgagctgagtcaagagctgctgcctgagcaggagatgggcgaactgttccgtgaagcgggaactaacatttttgcgctcggctatgaagaaccgaagggcagcctgcagcttcggcaaagcgtcgcggaacatttgaaaacaaaggggattcacgcgtccccggcatccatcgtaatcgtctcaggcgcgctgcaggcgcttcagctcatttcaatcgggctgctaaaaccaaactccgtcatgctgactgaaaacccgtcgtatctccattccctgcgtgtgtttcaatcagcgggcgtcaagcttaagggagtgccgatggatgggagcggaatcaaaacggatcatcttcccgcttaccgtcggcaatacgaagcggggctgctgtacaccattccgtcattccataatccgaccggaacggtaatgtcactcaagcggcggaaggaactcatcgcgctcgcaagaaatcaccgtctgcctgtcattgaagatgacgcatacggtgatatatggatcgataaagaaccgccgcctccgttaaaatccatggacggtgaggggaatgtactgtatatcggtacgctgtcaaaaaccgtaagcccgggtctgcgcatcggatgggtcgtcgcccctgagccggttgcagacaggctcgccgatattaaaatgcagacggattacggctccagcgctttatctcaatgggcggcatgtcaatggctgtcaagcggccgctatgaagagcgtcttttgcgtctcagaaaggaactcaaaatcaggagagatgcggcattgcgttttcttgaaagatacgcgggagatattgcggagtggcgtgtgccggaggggggcttttatatttgggtcaccttccataaagcattcaccgttcagacgcttttcatccgtgccttggaggccggcgtgctgatcaatccgggagctctctatcttcccgaagaccggcaaagcctgcgtctttcctattcgtacgcatctttaccgggcttggaaaaaggcattcaaacgatagcggacattgcccgccgtttcgtttaataaaagatcacgtcacaatggcgccgagcgcttctgcgaatgtaacggcatgcgccggagagatgcggcatcctttcagcttatcaagcgagacatgcagatgatcaaatgtgcacgtgctgatatccatattaaaaagagacgtgccgatgaagtttgcgccgttcaaatcacagacgtcaagatctgtgtattcaagaacggcatcattccactcactttctgaaaggccgcacgagtcaaaacggacatgcttcatattggaatagctgaaggagctgtaatttgcgaggcagtcttcaaaccgtacatgacgcatggcggaatccgccagattcaagccgagaagttttgaatgctgaaacgccgttctatggatgatgcttccgctgaaatcagcgtttgagacatcgcatttgtcaaacaggacatccgtacattccatatgtctgaaagagatatccgtaaaaacgatgtttctgaaaatgactttttcggcacgcaggccgtccagtttgccgtttacgatgccgttttcaatgatgacttctttgagctcctcatcctgaagcgcttcagtgaaagaaagcaccggcaattctttcgggattttcggtttttggatcgtattcatctcatactcccttttctaaacataatagctgaaatcggcaattggcagatatcgctttctgcctgccaaccttgctgttgcgtaatgtacaaagggtattaaaaaagcgggagggcgtcaatagtgtcgcatataaaagcagacgtgacattcaaggtaatgcccttagagacatgtccccaagggcttttgtctgtttcaggcgagttctttatacatgatcacatgcgggccgatgccgggtatgtcaaaggggctgcccgtgcttttccagccgagcttctcgtaatatcccttcacgtgacatctggcgttgcaccagacaagcgccgcccccatatctgccagttttcgttccgcataggcgattaacgtgcttcccgctttttgcgtccggtattcttcaagcgtcgccatgccgcgcagctggtaggcgggcgccgcctgtaaagcctgctggttctgcgggtagaaagaagcgatgctgatcaatgtcccgtcgtaaaaacctccgagatgaaatgctcctttgacgctgtcctgatcatatttacaatcctcaatcgtctgatgggggcgcagcacgctgtgtctgatcgcgtatgtgtcttctgcggtgatgggttttacttcaaccataaaaaaatcctcctttgcttgattctttttctgtatcgtaccatgaaaaagccgcctgtcatatcaggcggcctcttccgcgtcaatgcaaatatacatcagcccgcttttcatccttttgcttaatataagctgcaagctctgatgtcaaatcagaacggagaaacggggtgattaaataaattccgttaaacagttcgcacgccgtgtcgagaagcgacttggcgatggcgaggccttcggttttctgcttttgcttgtcttcgccggcgagcgccattttttcccggatgctgtctgacagcttaatgcccgggatttcatgatgaatgaactctgcattgcggctgctcgttaacggcataattccgatatacaccggtgttttgaggtgtttcgtttcatgatgaatgtcaatgagctgctgctccgagtagacaggctgggacacgaagtagtcagctccgcactcgatttttttctccagccgttttactgctttatcaagatggcggacattcggattaaatgctccggctacggaaaagttcgttttcttgccgagcggtttccctgataaagaaatgccctcgttgaattgcttaatcagcctgatcaagtcaaaggacgttaaatcatagacggaggtagctcccggaaagtcgccgatttttgaaggatcacccgtgatggctaaaatgtcggtgagcccgagcgtatccagccccattaaatgtgactgaaggccgatgatgttgcggtctctgcatgtaatgtgaacgagagaacggatatcaaggcgttctttcagcaatgaaccgcaggcggcattgctgatccgcggtgtcgccaatgaattgtcggcgagcgtcagcgcttctatgccggtttcttttaattcagccgccgcttgcagaaatttgtcaaaattcaattttttcggcgggtcaagctctacgataattgaccgtttttgagcggcgatttcgtttaaaccaggctcggtccgttcattccggacggagatgatttcttcttcccgtctgattttcacttctttatcagtgacgggagaaagtccgcggaccgcttcagccatggctctgatatggtttggcgtcgtaccgcagcagccgccgataatgcgcgcgccctgagtgcggaactgtacggcgctctcccggaaataggcatcgtccgtatcataaacaagcctgccttcttctaaagacggaaggctgctgttcggatagaccgataaataagcgtcacggaaaatcggcacttcggtgagcgcttcaatcatgtggtacgggccgagccggcaattgattcccgttatgtcagcgccgagatcggcaattgacctgagggcttcccgaagcggtgttccgtcctgcagcacgccctgttcgtgcatggatacgttcagcataatcggaagttccgtttcttttctcgctatcttcagcacttcgcgcgcctcttctaaatcatagtatgtttccaagagcagaccgtccggctcttcgtgaagcaataaataaagctgctcccgaaagctgcgtttaatctcctccaggctgtaggcgtttttgttaaaggtgcggatgccgcccatcgttcccaatacataagcgccgtctgaggaagcgcgcgcgattctgaccgcctcctgattgattttttttgtttcatcctcaagtccgtatcttgagagcttaataaaatttgcgccgtacgtatttgtctggatgatgtctgccccggcttcgacgtaagccttatgtatccgcttgatttcctcgggctttgatacgttcagttcctcaaaacatctgtcaatgccgtaggaatagaggagagtgcccatcgcgccgtctccgattaaaatccgttcttttaagtcttgtaatagtcccattgtttgcctccttcgtcacattcagcaaggaaaaaagagaaataaaaaaagtcttcttaagaagaagactttgtaatcatttgtctctcttcttatcttccaagctgtttttagcttgctggatttagcaccttggtcatggtttgggttaaaccattacaccggttgctgaagcgtcgtcgggccagtccctcggcttctcttgataagaacgttcatataattgtcatgggtttccaaaacttaactgtgaaaatccctttctccaaatttaccgaaaatagagacaataatcaataggaatcacataatttatctaaaattaataaattgaacgtcaatcggcaggtctgccccgcggacggctgcaataatctgctgcagatcatctttattttttccggtgacgcgcacttggtcgtcctgaatctgagacttgaccttcaagccggagtttttaatcaccgcgttgatttttttggcgctgtctttatcaatgccctgtacaagcttcgcgcgctggcgcaccgtgccccctgaggcattttcgattttgccgtattcaatgtttttcgtcggcacgtcccgtttgatcagcttgccgctcagcacatctttgagctgattcagtttaaactcgtcatcagaaatcaggacaagttcttccttttctaaagttacatcgcttttcgatcctttaaagtcatagcgcgtgccgatttctttcagcgtcatctgaatcgcattctgcacttcgggaaattcaactttggatacaatatcaaaagaactttcttttgccatgagaaaacctcctataacatttcacttatgagttgattatagtagaataaagagaaatgtccaactgcataaagcatgaatttatgcatattggaaaaaatgagaaaaacatcagccccatacgggcgaatcaggaaggacgataacatgagaccagggcagcagctcacgcttagtatagatcaccaaaccgatttcggttattttttaactgacggcgaggatacggttcttttacataacagtgaaattacagaggatattgaagacagagatgaagtggacgtatttatttacgtcgatcatcaggaaagactcgcggcgacgatgaaaaagccgcttatcagcttttatgactacggatgggtggaagtgacggacgctgtggaggatatgggcgtattcgtcgacgtcggtctgtcaaaagacgcgctcgtcgcaacggagcacctgcctccgtacaaatccgtctggccgcaaaaaggcgacagactgtattgcatgctgaaggtgacaagccgcggacgcatgtttgccaagccggcgcctgaggatatcatcagtgaattatttacggatgcagaggaagacgtcatgaataaagacctgacaggcacggtgtacagactgatcgcatcaggctcttttctgattaccgatgaaggcatccgcgcgtttattcacccttcagaaagaaaagaagagccgagactcggcagccgcgtgacggggcgtgttatcgaggtgaaggaagacggctccgtcaacatgtccctgctgccgagaaagcaggatgcgctttcggttgacgcggaggagattctgacctatctgagatcaagaaacggcgcgatgccttacggagacaaaagcgatcctgacgatatccgcgaacggtttcatttaagcaaagccgcctttaagcgggcgctcgggcacctgatgaaaaacggcaaagtgtatcagaaagacggctggacatacgaaaaacaataaattttctgcaaaaacatcggtgaaccaaaaccggtgttttttattttctcaaaagctcctatatccctcatttgtttatcaacctgccgaacatacatattttattgaaataaaatattctgacatccgaaccgatatataactatagaaaaaaacaaaaggagagtttcaatgagaaaaatggcgatatttgcggctgtactgctgcttgcgctcagcacggcgggatgtgccggcaaatccgaggagacggcggccgaaaaaacgaaaacaatcggcatcatgctgacagacaacggcctcggcgaccaatcatttaatgattcaggctttcaaggtttgatgaaagcaagagacgagctcggcatcacatttgattacagagaaataaaagacaccggtacgtacgaaaaaggactgacccagcttgtccgggaaggcaatgatcttgttgtggggctcggttacagcatgcaggcggatttagaaaaggtcgccaaaaaatatccgaagcagcggtttgtgctgattgattctgtatcaggactggataatgtcacctccgtcacgtttaaagaggatgaaggaagcttcttagccggagcgctggcggctatgacgagcaaaaccggcacgatcggatttatcggcggttcagatgccgacgtcattaaacggtttaagaaaggctatctgaaaggcgcggaatcagtcaaaccgaacatccgcgtgctgtcggaaatcagcggtacgtttgatgatgataagctcgggaagcgcatcgcccaaaacatgatccgaaaaaaagccgatgtcctgtttacggcggccggcttcacgggtgtcggcgcactgaaagaagcggaggcgcgaaaagtatacgccatcggtgttgacagcgatcaatattacaccgccgagcacgccgttatctcttctttagtgaaaaacgtcgaccatgtcatctatgaattggcgaaagatttaaaagacaacaaggagatcaaaagcggtgagatcgtttacggactgaaggaaaacggcatggacttagccaagatcagagttgtcaaaaacgcaggcgggctgacgaaaaagatcacggatatgaaaaacagtctgattgaaaaaggaggcgatctgaagtgacattacggacaaggctgctcgttaacgcagccgttacgatgatttgcttcgccgccgtcatcggctttaccatcgtaaacatgatgaagattcaggcttcaaatgaagatgaagtggacacgctgttaaacgtccaggaagcaaaagctgaccttaatacgttaaaagaaagtatcaccggctattcctatacgctcgcagacgcccagaaagaagatgtacgaagctatatgaaaagcagctcagacaaactggcggcgctcaaaaaaacgatgagggacgatgcggacaaagccgcttttgacaaactcgccaaaaaatacgaatcatggcaggcggaggcggacgctgcccttgattcgaaaagcccggctgaagcgacaaggacggcggcccgcatcaacggtctcctgaatgatatttatatgctgaatctgaaaagccgggatcactatgaagacatgcagaagcagacggctgaccagattcagtttatcgtttacagcgcagccgtgctgaccatcgtgatacttgccgtcaccgtcatatcttccatcaggctgacgaagagaattgcagggccgatccgccgcatggctgaaaatgcccgtcgtattgcaggaggaaaccttgctgttgaaatgcttgattataaagggaaggacgaactgaaagagctgaatgactcattcggaatgatggctgaacagctccgcaccttaattcaggcgatcggagaggtcggccgtgaagtcgagacttttgcggaaggtttgacgaaggaaaaccagacgctgaaggacatgaccgagcaggtgtccgtatcgacggaagaaatggcgcaaggctcccaaaccatttcagaagatctgcagcatgcggtgcaattcattgaacaaatggatgaacattcaaaggcgaacgccgaacgttcaaaacaaacgacgagaagcagcgaagagacgattgctgcggtggctgcggggcgaggtgctttagccgagaccaagcaagccattgataaaagcaatgagacatcaaaagagatttccgaagccgccgatctcttcatagagcatgcggcaggcatcagtatgatggcgcagaccgtttccgacattgcgggccagaccaatctgctgtcattaaacgccgcaatcgaggcggccagagcaggcgaggccggaaaaggatttgccgtcgttgccgaggagatacggaagctcgcagacggatcagccaaagcgaccgcgcagattttcgatatggtaaagcaaattgaagacggcatcacatctattaccggagctgtcacgaccggcgtcgctttagcggacagacagcaggagctgatggagaaaacgtcagaatcattcgcccatattgaacaaaaagccgcccatattaaggcggagcttactcaattggacggacggatcatcgaatcgaaacagcttggtgagcaagtgctgcatcatgcagaaagcatcagcgccgtcgttcaggaaacggctgcaggaagcgaagagatttctgcctccgcgcttgagcagctgtcttcttttcataaaatggcggaaagcgtcaataatctggtgagcctgacagagcggttaaatgatcaggtccgccggtttactttgtaacagacatccgtgcgcaaaaaacagccctctttcttctaagacaagagggctgttttgcttttacagatggtccggttttttggaattctggttttttcccgcctgccggtttttttcggcaagccggttctttttctgatttacggcgttattgtccaacggttttttgtcatcatctttcatgcggcaaagcctcccttctgtccgttaggatgcccgcccgcattgaaattatggcttcaggaaaaaaatcgcgagcgtgcccggcccggagtgggcgccgatcgcagagccgattgaatgaagaatgatctctttcggatggaacgcttcttcaatcatttccttcatcccaatcgccgtctcttcattatctgcatagctgattcccacggtttgatccgcccaatcgccgccttcttccttcatcatttctataatccgtttaaacagtttcttctgtccgcgcaatttttcgagcggcacgagcctgccgtcatccacatgcagaatcggtttgatgttcaaaagccccccgacaaaagcggacgtttttgaaattctgccgccccgcgcgagataagcgacgtcatcgaccgtaaatatatgtttcatccgtgcgcaaaagttctttacagacgtttcgatttcttgtattgtattcccgttaacacagagtgtttgcgcgtgcatcaccgcgaggccgcagcccagtgaagcgcatttggaatctacaatccgtaaatcaaaatcgggaaattcctcttttacttcattggcgatcattacggccgtctgataggtgccggaaagacctgaggaaaaggcgatgtatatcgccggttctcccagttccgcgtattgtaaaaatactttttttatcgtatccggtgatgcctgggatgttttcggaactttcccgtcccgcatcgcttgaaagatatgatccgcctgaatggtgactgcgtcctcatattcgtttccgtcaagtgttacgtgcagcggaatgaacccgatccggttttcttcaatataagatttcggcaggtcagaggcgctgtcagcaataaggtgaactgtcatcataattcccttctttccggttggtgagagtatgccaactatatcatataaatttggcaaaatagtgttcaaaactttattttaagggaaaagctaataatgaaaatgagcggaggagcaagccatggtactagaacaagtaaaaaaattagcaatcgtcgtcatcggcgcgtttctgtatgcggcgggactgaatttattcctgataccggcgaatgtatatgccagcggttttaccggtgtcgcccagctgctgtcaagcgtcgttgatcaatacgcccccttttatatttcgacaggagttctcatgttcctcttaaacattcccatcggtgtgttaggatggctgaaagtcggcagatcattcaccgtgtacagcatattaagcgtagcgctgacgtccgtctttatggggattctcccggaaatgagactgtcacacgatattcttctgaataccgtattcggaggagtcatctcagctatcggcatcggtttaacgctgaaattcggcgcttcgacaggcggtcttgatatcgtgtcgatggtgctggccaaatggaaggataaaccggtcggcacatatttcttcattttgaacgggattatcattttgacggcaggattattgcaaggatgggagaaagcattatatacccttgtcgctctgtatgtcacaacaagggtgattgacgccattcacacgcgccacatgaaactgaccgccatgatcgttacaaaaaaagctgatgaaatcaaagaagcgatttacgggaaaatggtccgaggcattacgacggtgccggcaaaaggcgcttacacaaacgaacagaaagaaatgatgatcatcgtcatcacgcggtacgaattgtatgaccttgagaaaatcgtgaaagaagtcgacccgaaagccttcacaaacatcgtgcaaacgacggggatctttggtttcttcagaaaagactgataggagcggatagaatgaagtggctgtttggcctgttattaccggtcattttattgatcggatgcagcagtcaatccgggcagaaggagcccgctgaggaggtatccggagagatgaatgaacagcaagcggaattagccgtaaatcctgtgcagacagatcagcagatcgaatttcaaatgtctttaaaaaacaaaagcgaaagcccgatcgatttcacattcagctcagggcagaaattcgaactgaccgtacatgaccaacatcacaaagaactgtaccgctattcaaaagacaaaatgtttacccaggcgtttcagaccgtgaccttaatgccgaatgaaacgtatgacttttcagatgtgtggaagaacgtgcccggtccgggaacatacacggtgacggtgacgtttttagggaagtccgatcagatcggaaaaagactgaaaacggtaaaaacatttgaagtaaaataaaaaagtggcgccctcatctcaaacggggcgcctttttttattgcaatttctccagctgatcctgaaattggtgcagctgctgacgttctgcatccgtcgaattggcgtacgcggaagacacggcatttttggcgcgtgagacagctttttcctggtcgccgtcctcgaaaccgttagcaatcatgacggcctgctggacaaatgacttggcttgagaaaacagttcgtttctcattaaaagtcaacctgcctttcagccgaatcttttgctgcatcatgctgtgcttcctctaatgtagaccgatatggaaatcttgcgtcatgaagactgacagagtccttgccttgctgaataaaccgttttgatttgtttcgtttacccattgcaatgtcccccttccatatttagacgagatgagtcgtctgttttagtatgggcggaaggctttgtgttatgagcgggaaaacctcacagggagaaataggattttaaaaattcggcgattccgtccgcttcatttgaacccgtgacgcgatcggcggcctgtttgacttcatccgtgccgtttcccatcgctacgccgcacccggcaaatcggagcatttcaagatcgttgtcttcgtcgccgaacgcgatgatccgttctctcggcacttggtaatagtcgctgattttcttcaggccgaccgctttattcatcccgtgtttaataatttcaatcacatgccaaggagccgcccatcttctgtggtcaatgacctcggcgtgcacatcagataaatgcgcgcgtatgtccgcgacgtcctcttccttcgcgtgaatcaatacggacgtcacatcctcttggaccgtttcgcgcagatcgccgaatgtgacattcgccgtattcatatgaaacgcctcaattaaatgctcatcatgatagtggaagtacacatcatcaatgatctcagcgagcacattatgtatttgataggtctctgtaagttcggcaagctgtctgaccacatcgacagatagagacgtgtggtagcgtccccatgactcgtctttcgggtggtggacaaacgctccgttaaaattgacaatcggcgttgtcagcccaagctcgtcataatacatcgaactggaacggaaagggcggccggttgagatgcagacatgatggcccgcttctttcagcgtctgaatcgtccgtgccgtttcaggggaaatggttttatcatcttttaataaggttccatccagatctaaggcgatgaggtaaggttttgtctccataaataactccttttgtcatataatttgctgtttttctcttatgtacagtgtagctttttaccatctttattgtctacatgttacacttatgattatggttatcctaaggagggagtcaacgtgattcttattgatcatcaaactgtatcaggcattccgtttttacatattgtaaaagaagaaaatcgggaccatcccgctccccttgttttctttattcacggttttacaagcgcgaaggagcataatcttcatttcgcttacctgcttgctgaaaagggtttcagagccgtgctgccggaagctctttaccacggtgaacgcgctgaacagctgtcagcagaagagctcgccgtccatttttgggacattgtcttaaatgaaatcgaggagcttgacgtgctgaaaaaggattttgaagcgcgcggtctgattgaagacgggcggatcggtcttgcggggacgtcaatgggcggaattacgacattcggcgcgatggccgcgtatgattgggtcaaagccggcgtcagtctgatgggaagcccgaactatacggcattttttcagcagcagattgaccacattcaaaagcaggacatcgacattgacgtcacaaaagaacaggtcgacgaactgtttgcgcggctcaaaccgttcgatctcagtctggaaccggaaaaactccgcagccgcccgctgctgttctggcacggcgttcaagacaaagtcgttccgtatgcaccgacccgcggcttttatgaaacgattaaacctcattacagcagccggcctgaccatcttcagtttctgaaagacgaacgggctgatcataaagtcccgagatacgccgttttagaaaccgtcgcctggttcgataagcatttataaagcacaaaggtgttaacaatacccgcttttacgttatactgaggaaaaaggagtgatggaacgtggaagaagcattaaaagaaaacatcatgggcgccttggagcaggttgttgaccctgagctcggcgtcgatatcgtcaatctcggtcttgtatacgacgttgatatggatgacaacggcctgacgcacgttacgatgacactgacatcaatggggtgcccgctcgctccgatcatcgtcgacgaggtgaaaaaagcgctcgccgacattccggatgtaaaagagacggaagtccacatcgtctggaatccgccgtggacaagagacaaaatgtcacgctacgcaaaaatcgcattagggattcagtaataagaaaatgcacctcggattttaggtacatcctaaagtttggaggtgcttttcttttgtctgcatataagcgacggtgagggcttgttttggatcgcaaacaaaatcctcatatataaaatttcatatgaggtttatcttttttgtaataggacagtctgtcctggagtgtacctgtgtggaattcaaatttatgtccatcgggatcagtaaaataaattgacttttgatcttgcttatccctaggacgcccatttaatatatttacatttagattttttaacctttgatgtattgcatcaaaatcttttgggtcaattgtaaaggctgtatgcgtataggatttatgtatttcatttcttggtatatccgcctctaagttaagtgcaagccaaagcccgttcagatcaaaatatgctgtcttttgtcctttaaccagaagttgtgcatgaaatactttctcataaaattctattgatttttccaaatctgaaacagaaaaaagaagatgattgatcccttttatgttcattttccccacctcatttaacatctttgttttaaacaatccctttggtaatacatctgcatatatatcgattatatactgactaaaaatcatttttagggatttctgtgtattttttatgcccggtgttttccggatgaccgttttgaactgtactaaacatgattctgccggggcccgttttgtctgctttgtcgctgcagaccggcgtgcggaaagaagggcaagtcactaaaaaaaccaagtttcccgccattcgggggtttttgcggtatcgggttaaaaaggaaaaaaacggacggaggcatgatataatagaccggctgcatgcgagggaggaacccatgaagaaaaaattacttctcattatccttagcattcttgtttatacggcgctgttcgctgtttccgcctttcacaaagagccggagcggcaggcagggacaatgacggatgtcagccgtctcatgcccgtgaaaattaagcagacggtcaaaggaaaagagaaagaaacattggtcgaaacgattaaggaagcaaagagaaagcatctgaagatctcaatcgcaggcgcccagcactcaatgggcggccagacgtattatgaagacggtatcgttctcgacatgacgggctacaacaaaatactcggtctcgaccgaaagaaaaaaatcatcagagtgcaggcgggagcgacgtggaatgatattcagcgctatgtcaatccgtacgggctcgcggtaaaagtcatgcaatcgcaaaacatttttacgatcgggggctcactgagcgccaacgcccacggccgggatatccggtacggttcgctgattgatacggtcaaatcgtttcatcttttaaaggcggacggcaaagtcatcaccgttactccgaaagatgacctgttttcagccgtcatcggcggctacggcctgttcggggtcatccttgacgcggatattgagctgacggatgatgagctttatgaaatgaaaacgaaacgcatgaacgctgatacatacagtcaatattttacgcagcatgttcagcgcaaccccgccgtgcgcatgcatctcgcgcggatcgcaacaggggataaaggctttttacacgatatgtatgtgactgattacacactctcagacaaccagaaagaattaaagcggcacaatgaactgaaagaagatgagcatctggcgctgacgaaattcgcgctcggcctctcccgccggtatgactggggaagaaattggttctggtccacccagcagtcttattttctcagccaaaacggtgtgaaagtctccaggaacaatgtcatgcggtcagaatcgaagtttttggaatatgaaaacacggacaacaccgacgtgcttcaagaatacttcgtgcccgtcggcgaatttgcgccgtacattcatgatttacgcaagacgctgtcacatgaagagctcaatctcgtaaatattacgatccgctacgtgcaaaaaaatgaaaaagccgatctgtcatacgcaaaggaagacatgttttcactcgttcttttaatcaatgaagggttttcaaaagacagccaggcgagtacagcgcggattgtcagaaaaatgacggatacggcattgtgccaccgcggcagttattatctgccgtatatgctgtatcaaacgaaagagcagatgcgcgaggcatatccgaaaagcgatacgttctttcggaaaaaacacaaatatgatcccgatgacttgtttatgaattatttttatcagaggtacaaatcatgaaacacaaccatttaaaatggctgatcctgtctcagagcagtgtcttttttgccggcagcctgatctttccgttttatattttatttattaaaaacatcggttccagctacacgcaattcggtctctcatacggcttgttcggcctgagcggcgcattgattcatccgctgctcggccggctgtcggcaagactggatccccgctggttcctgatggcgaattcgtgggggatggcggtgcttcttctgacgctcccgcatattaccggcgtgcaccaggtttatgttgtgcaggtgcttttgggcctcttcggcgccatgcaaaaacacggcgagaaaatcatgatcgccgattacaccgacggcggggagcgggggaaaaaagtcggcagctatcatttctggacggccgtattttccgctgccgccattattctcggcgggtttctcgctgatttctttacggtttatattattttttacgccagctccgtgcagttttttataagcgggctgatgatgctgaaaaaaacagactgatccgatcagcctgtttttcttatgaaaccccctcgatcgagagggggttttttgtcagcgaaaaccgatggaaaatgaatgaaaaaatattaaatatacaattgaattaatttttattcatgttataatgttaaataatttcacaaaaaccaagaaggtgaacccgttgaaaataggtattataggcgcgactggttatggaggcgccgaacttgtcaggattcttaaccatcacccttatacagaagattgtatattatattcatcgagcgacgaagggaaagaatatgccgcttcatatccgcatttgaggaatatagcgtcacaatcacttcagccgcttcatatagaaacgattcgaaacgaaattgatgtcatgtttatagccgcgccgcccggcgtttccggagagtggtcgcccaagctggcggaggcgggcatcccggtcattgatctatccggtgatctgcggattcaaaacccggccgtgtatgaaaagtggtataagcggaaggccgcgccgaaaggaacgcttcaaagcgcggtttacggtttagccgaactgcaaaaagaagagattcagactgctaagctgattgccaatccgggatgttttccgacggctgtgctgctcgggctcgccccgctggcgaaaaataagtttttacaagattcatttctgattgttgatgcgaaaacaggcgtatccggtgccggccgaaaagcatccatgggcactcattattctgagctgaatgataatttcaaaatttataaggttaatgagcatcagcatactccggaaattgaacagcaattggcggcatggcagcccggcacaggcccgatcacgttttccgctcatttggcgccgatgacaaggggcattatggcgacgatgtataccgacgcccctccgggtatgtctgctgcacaggtaagagaattgtattccgaattctacaaagattcatattttgtcagaatcaggccggaaggtgaatttccggcgacgaaagaggtatacggcagcaatttttgtgatatcagtgtcaccgtggatgagagaacaaaccgtgccaccatcgtttctgtcatagataatctgatgaaaggcgccgcagggcaggcggttcaaaatttaaatatcatgaatggctggcaggaagaaacgggacttacgatgacgccagtctatccatagaacgaaagagggattcgaaaatatgattcagctgagtgaggaaatcacgaaaataaaaggcggcgtatcctcgccgaaagggtttgaggcaaagggcgtgcactgcggcctgcgctattcaaaaaaagatctcggagcgattatcagcgaagcgcctgcagtcagtgcggcggtatatacgcagagccattttcaggcagcgcccttgaaagtgacgcaagagagcttaaaaaaagaggccgtgcttcaggcggttattgtcaacagcgcgattgccaacgcctgtacgggagaccaaggattaaaggacgcctatgaaatgcgggacggcttcgcgagccagctcggcattgagccggagcttgttgcggtttcgtcaaccggggtgatcggcgagcttttagatatgaaaaaaattcaggcgggcattgaacagctcggtcaagcgccgtcagtgtccggagcatttgaagaagccattttgacgacggatacagtgacgaaacagacgtgttatgaactggtgatcggcggagacatcatcacgatcggcggagcggcgaaaggctccggcatgatccaccccaacatggcgacaatgctcggctttgtcacaacggacgcggccgtggaagaacaggcgctcaaaaacgcgctcagagagattacggatgtttcatttaaccaaatcaccgttgacggtgaaacatcgacgaatgacatggtgcttgtgatggcgaacggctgcgcggggaatgattgcctggcggaggatcaccctgactggccggcttttaaaaagggattaaagcttgtatgcgaagaccttgccaaagatattgccagagacggtgaaggagcgacgaaattaattgaagccagagtcgaaggcgcgaaaaataaccttgaggcgaatattatcgccaaaaaaatcgtcggctcaagccttgtgaagaccgccgtttacggcacagacgccaattgggggcgcatcatcggcgcaatcgggcacagtgcggcaagcgtaacggccgaacaagtggaagttttcctcggcggtcagtgtctgtttaaaaacaacgaacctcagccattttcggaaactgatgccaaggagtacttatcaggtgatgaaattacgattgcagtccgcctgcaggaaggctccggcagcggccgggcatggggctgtgacttaacctatgattatatcaaaatcaatgcgagctatcgcacataacaaaggggagcggcatgaagaaaaccatcgtttttaagtgcggcggaagcgtaatccgcgagttatccgccgatttttttcaaaatgtaaaagagcttatgcaatcgagctggaacattgccgtcgtgcatggaggcggcccggacatttcaagaatgctgaaaacattgcagattgaaacggaatttgtcgatggacagcggaaaacgaccaaaccggtgctggaaacagcggaaatggtcttgtcagggacgatcaataaatttttcgtaaccgaactcgcgaaaaacgggctgaaagccgcgggaatatcaggaaaggacggcggtctccttcaagcatcttaccttaatcaagacaaatacggagaagtcggcgaaatacaaaaaaccgatccgtcaatcattcacgcattaatgaaagaaggcatcattcccgttatcgctccgctttccatgacaagtgatttcgaaacgctgaacgtcaatgcagacgccgcggcatcggccgtcgcttcagccttacacgccgataaacttttatttgtcacggatgtcgaaggaattatggacggagagagcaggctggatactttgacgccgcaagaaattcaggcccttatcgatgacggcgtaatttcaggggggatgattccgaaggtaaactcggcattatcggcactgagtgaagatgtcgcggaagtgatgatcgtaaacggaaaaggagcgtttttcaccaatcaagccttccgaggaacaaaaatcgtcaaagaaaaggagagcgtgtcatgagcagcctatttcaaacctacagccgctggcctatcgatattaaaaaagcgaaagggacaatcgcagaggatgaaaacggaaaaacgtatctcgattttattcagggcatcgccgtttccaatctcggccattgtcatgatgcggtgacagaagcggtgaaagaacagcttgacagcgtatggcacgtttccaatctgtttgaaaatgatcttcaggaaaaagccgcggcaaagcttgccggacatagcgagggggatctcgttttcttctgcaacagcggagccgaagcgaatgaaggcgccattaaacttgcccgtaaagcaacgggaaagacaaaaatcgtaacattccatcaatcctttcacggacggacctatgcggggatggccgccaccggacaagacaaaatcaagaccggtttcggaccgatgcttcaaggctttcactatcttccgttcaatgatccgtcggcattcagcacgctttcaaaagaggatgatatcgccgccgtcatgcttgagacggtgcagggagaagggggagtcaatcccgccgatccggaattcatcgaagccttacagacattttgcaaagacaaacaggcgctgcttatcgcagacgagattcaaactggaatcggccggacgggcaaggcattcggctatgagcacttcggcatctctccggacattatcactgctgcgaaagggcttggaaacggttttcccgtcggagccgtgatcggcaaaaagaagcttggcgacgcctttacgccgggtacgcatggtacgactttcggcggcaataagctcgccatggcagctgtgaaagcaactttggacattgtgtttcagccggactttctccaggcggcggcagacaaaggctcttttttaaaagcgcagctgaaccgtgaactgacagggccttttgtaaaagaaatccgcggaaaagggttattaatcggcattgaatgcgcaggtcccgtgtccggcatcatcggagatctgcaggaacgcgggcttctcgtgcttccggccggaccgaatgtcatcaggctgctcccgccgcttacggtttctgaagaagaaatgctgtcggccgtcagtatgctgaaagcagcgatcgaagcgcattcggcagtgaaacggtaatttttttcaatataaaagtataaaaattcatttttttaattaattattcatcaagaggtgggctttagatgaaaggctatttagtattggaagacggaacatcattcggcggtgaacttgaaaaagaggcccgctgtgttggagaagctgtttttttcaccggaatgacgggctatcaggaagtgcttacagacccgtcatataaggggcagattatcgtctttacgtatccgctgatcggaaactacggaattaatgaaaaagaccttgaaagtaaaattcctcaagtcaaggctgttgccgtctatgaagcgtgtgaacatttttctcaccatgaagcagtctcaagcttgagagagtatttaaataaatggaacgtcccgctcttaaccgaagtggatacacgggccgtcgtcaaaaccatccgctccggcggcacgatgaacgctgccgtgtcaacaacaggagaaattcccgcagcatccggaacacaaaacccggcggagctggcgcagtctgaagacatcacttcaatggggaacggagaccggcatattgcgctgattgatttcggttataaaaaatcaatcgcctcgtcacttgtaaagcgcggctgtaaagtaacggtcattccgtatcagcagatggatgccgtttatgacattcagcctgacggaatcgtgctctcaaacggcccgggcgacccgaaagcgattgcgccgtacatgaaccggattacatctttactcagtgatttccccgcactcggcatttgcctcgggcatcagctgattgccctggctttcggaggaaatacgtataagctgccgttcggccacaggggtgccaaccatcccgtcattgaccggaaaacgaaacgggtgtttatgacaagccagaaccacagctatgtcgtcgatgaagcgtcaattgacgaaaacgaactatcgatcagatttcatcatgtcaatgatacatcagtggaagggctcattcataagcgccttcccgtattaagcgtccagttccaccctgaagctcaccccggaccggctgagagcgagtggatatttgatgaatttctagagaaagtgataccagcaaggagagaaatcgctcatgcctaaagatacaaccatttccagcatattagtcatcggctccggccccatcatcatcggccaggcggcagaatttgattattcaggaacgcagggctgcatggctctgaaagaagaaggataccgcgttattctagtcaataacaacccggcaacgattatgacggatgaggcgtttgccgatgaaatatattttgaaccgctcacaaccgacagcatcgaggccattattgaaaaagaaaaacccgacggtctgcttgccaatttgggcggccagacggcattgaatttagccgttaagcttgaagaagcaggcgtgctgaagaagcatcacgtcaagctcttaggaacatcggtggaaaccattcaaaaaggcgaagaccgggagcagttccgcgctctgatgaaagagctcgaccagcccgttccggaaagcgaaatcgtcgataacgaagaagacgccctccgcttcgctgagtctatcggatttccggttattctgagaccggcgtacacgttaggcggaaagggaggcggaatcgcgaaaacgaaagaagcgtttcagacgcttattaaacaggcgctgttagcaagcccgatcagccaatgcctcgtcgaaaaaagcattgccggatttaaagaaatcgaatatgaggtcatgcgcgacagcaatcatacatgcatcaccgtctgcaatatggaaaacatcgatcccgtcggcgtgcatacaggagactctatcgtcgtcgcaccgtcccagacgttaacggatgaagaatatcagatgctgcgttccgcaagcctggcgataatttcggcgctggatgtggtcggcggctgcaacattcaatttgcgctggatccgttcagcaaacagtactatgtcattgaagtgaacccgcgtgtcagccgttcatcggccctcgcgtcaaaagcaaccggctacccgattgccaaaatggcggcgaaacttgccgtcggctatacgctcgacgaactgaaaaatccgctgacgggctctacttatgcaagctttgaaccggcgcttgattatgtcatcgtcaaattcccgcgctggccgtttgataaatttaaacatgccgaccgcacgctcggaacgaagatgaaagcgacgggagaggtcatggcgatcgaaagaaatatggaagcggccattcaaaaagcggcggcctcccttgaactgaaaacgatcggcacccgcctgcctgaactcggcggctgtacgatcaatcagctgtgggaattagcggtaacgccggatgaccggagatttttcgtcgtcatggaactgttaagccgcggtgaaacgatagaagatatccatgccaaaacgaaaattgacccgttttttctccatgtattccgaaatatcatcacattggaaaacaagctgatggaagaaggggatcatctgtctgtcccgcttttaaagcaggcgaaggtaaaaggcttcacggatgtcatgatcgcatctctcacgggaaaaacggaagaagacatccgtgctctcagaaagaaatcaggcatcgtcccgtcgtttaaaatcgtagatacatgcgccgctgaatttgatgccaagacgaattatttctactccacctaccttggggaaagcgacggagatgtcagccgaaaagagaaaaaacgcgctctcatcatcggctcaggcccgatccgcatcggtcagggagtggaatttgattacagcgccgtccacggcgtcctgaccctgcaaaagctgggatatgaaacgattatgatcaataacaatccggaaacagtaagcacggattatgaaatcgccgaccggctttactttgaaccgctgacgacagaacatattttaaacgtggcggaacatgaaaacattgattttgccatcgtccagtttgggggacagaccgcgatcaatgccgctgaaccgctggaaaaagcgggcattccgctgctcggaacatcctttgaaacccttgatgcgctggaggatcgggatctgttttatcagctgcttgatgatcttgacctcaaacatgccaaaggcgaaacggcttattcaaaagaagaagcaacggaaaaagcaagccgaatcggctaccccgtgctgatccgtccgtcttatgtcatcgggggcatgggcatgatcatcgttcattcagaagcgcaaatgtcagagctcctggaaaaagaagcgggcatgccgtacccgattttgatcgatcagtacattacaggaaaagaattggagatcgatctgatttccgacggacatgaagtattcgtgccgacttacacagagcacattgaacgggccggcgtccattcgggcgacagttttgcgattcttccgggtccgtctgtcacacctgatatgcagcggaatataaaagaggccgccgaaaaaatcgcggtaaaactggcttttaaaggcattatgaacattcagtttgtcattgatgacaaaggggatattctcgttcttgaagtgaatccgcgggcaagccgcacggttcctgtcgtgtctaaggtgatgggggtgccgatgatcccgcttgccgccagattgctggccggcgcttcccttaaagacatcaagcccgaggttcaaaatcagcacggaactgcagtgaaattcccggttttttcttctcacgccattcaggatgtggacgtaaagcccgggccggaaatgaagtcgaccggagaaggcatgtgtgtcgcgtttgacgcagaaagcgcactgaaaaaaatctacgcgcacgtctgggagaaaaaaggcagcatctatctggaaggctgtgatgcggaattggaacgtcaggctcaagaggcgggatttaccgtatgcaaagatgcgttcccggcatgggcagagcgaaaggataaagcggtccatattaatttcaatcactctgaagaagcgcgtaaacaacggatcgaagccatgacgcacggtgtgacggtctttactgaaccggaaaccgtaaaggcatttttagcaagcggctccggcaaacctcagcctgtatcgctcaaagatctttatcaaaaggaagtggcatcatgcacacaataaaagcggaacacacattaacccatttgtacggcaaagattttctttcattaaaagatgtcagcccgtcagacatcaatgcgcttctgacagaagcttcattattaaaacaacatccgatacagccgattttccaagggaaaacattggcgatgatttttgaaaaatcttcaacccgcacacgtgtgtcttttgaagcgggaatggcccagctcggaggaacaggactatttctttcaagcagcgacctgcagcttgggcggggggagacggtcgcggatacggcgaaggtactgtccggcttcgttgatgccattatgatccgcacctttgagcatgaaaaagtcgaagagcttgccgagcatgcagacattcccgtcataaacgggctgaccgaccggtatcacccgtgtcaggcactcgcggatctgttaacgatacaagaaataaaaggaaaattaaaaggagtaaaagtcgcctatatcggtgacggaaataatgtcgcgcattcacttatgatcggctgcgcaaaaatgggctgtgacattgcggttgcttcgccgaaaggctatgaagcagaggaagaggcagtgaatgccgcgagagaagcggcggctgtttccggagcgaaaatcacccttaccgaaaatccgcaggaagcggtgcgggatgcagacgtgatttactccgacgtcttcacgagcatggggcaggaggaagagacgcagcagcggctgaatgtgtttgcaccgtatcaagtcaacgcctcactcgtcagtctcgccaaacccgactatacatttttgcattgcctgccggcgcatcgggaagaagaggtcacgtccgagattatagacggtccgaactcggcggtattccagcaggcggaaaaccggcttcacgcgcaaaaagcgctcctgaaagctcttctttacaaacaggatgaacaaaaaaaccgctgaatctcattcagcggtttttgatatttctccgcatacaagcgcatactacataaaaaagaaaaaggaggaaatgacgtgggacagcagcatcaattccgaccgggacaaaaagcgccgaataacggtgtgtacgttgaaatcggcgaaacgggaagcatggtcaaaaacccgcaaaaaatcaagcttacggtgggagaaatgttccctgaaacttcaaaccacaacagattgtggacgtaccaacgaaaaccgtgaacacaaaaaaacctgctgaatagcaggtttttttatttaatgctggtttgcatcctgtttgacaggcatgatctccgcaagaacaaagactagcaccgcaataaccacggcaataacggatgattgcttgaaattgtacgccgcgctgttcatggaggcgatcaaataacaggccatatgtgttaaaaggaacgtccaaataaaaccgataactaaccgcacgtttccacctcgtccttcattttattctacgttgtatcataccatacataaagcgcgggcggaaggtcattttctcatcaaaaagcgcgcctgaaactgacatatgcccgcctgtccggccgtctgacggaaaattcggttcctgtgcttgggataatagccaaaacatagcagcaaataggagtttatccgatccgttttcattcttcttacatatgatagccaatagagagattaggagtaaaaggaggcgggcaggcatggggataacggaaagatttttccaattcggatctgagctgaacgtcatccatctgccgtatcggccgaacggcttctgtatctttattctgggggacagaacccactttgtcagccgggactcgagcttttggctcgaacatgaagggagaaaccggctgttaaatacgctgcttgacagagggtacaccattttcaacagcaatttatacggacggcattggggttcggaaaaagccgccctttacgccagacagctgattcattatgtgctgaaacaagaaaccctcaatccgaaaatacatttgctcgcagaaggcatgggcgccctcatcgccgatcaattgctgcagtcttcaccggagcatatccgttcagccgcaatgttagatccttgtcttgatcttcaagcccattttgaatcagagaaagaaaataagtttttttataagcagtttctgagggaaacggcacaaagcttcggtgtttctgaaaaagaggcaagctcactgagctatcagaccattaccggctgccgcacccgcgcgccggtacatatatggcaaagaacgaccggagcgccgtacccgtacaccctgcatgcgaacgcgtataaagaagcccgggaaaagaccggaagcaagactgatatcacgtatcacctgcttgagaaccctgctcgtatttacagagccatctgccggtttttccgcagtcatgaaaaagacctgtaatgaatagaatacaacagccatctcttttcagagggctgtttggcttgtgtgtgaatgaaaaaccggaaaggcggcagatgtgatgaaaacagcgctgatcattggagcagatgaatttctcggcctttcattgtgcgaacggttgatggatgagggtgtgcacgttgatgtcattttggcagaaccggaggacaaaacgaggcagctgtatttagaagaacgtttaatgtggctcgcgaggaacgggctttttcaaataataggtgaaatcagtgaaaaggaatacgatcgtatctgcgttcaatacgggagcgggtgtctgcccgaagaaagggctgagcctttatattggattgtttacagtgaggatcaaggagactgggaaaaaaacggtcagcgggatacggcaaaagcgattatccttcctcccctttacggtccgtggacggaagaaaaagaagatggcgaaagcaggatctttttagaagacgcggtctgcgggctgatgaataagctggaggctgacggcacagaagacgaaaatcagattattaccctggaaataaaagaaaaaacgcaaaaaacagaagcggaagaaaaaattaaagaatggaaaagacaattttcatcaatattcgacattttttaagaaataccttccatgttatgtgcattaccgctacaataaacgtatatcaattatatatgttatgagtttgaaaaggggttgaacatggcttgatcaccaggcttgtcatgatcttttctgtcctccttttattgagcggatgcgcacaaactccgtttaaaggaaaaattgagaaggtcggaatgctttttcccgataccatcagtgacttggtatggggcacaaaaggttacaaaggtttattagcgatacaatctgaatttaacgttgacgtttattataaagaaaatatcagatccgatgaagatattttaaaagcgatagatgattttcataaaaaaggagtcaatcttttatacgggcacggaaatgaatacgaggaaatcttcaatatgatcagcaaggattatcccgacatggaattcgtcgtcgcaaacggaacggcgaaaagcgataatgtcacaagcgttcaccttatgggagaagcaatgggctttttcgggggaatgacggccgcccatatgtcaaaaaccaatgaggtaggtgtcatcgcctcctttctgtggcagcctgaagtagacggctttatcaaaggggcgaaatatgaaaagcctgatatcaccgtcaatacggaatttacggaccactgggataacggcaatgaagcgctgcatctttacgagaagttaaaagcggaaggcacggatgttgtatatccggccggagacgggtataatgttcctgtcattcagcaaatcaaaaaagacgggctttacgccatcggctatgtcgccgagcaatcgaatctcggcaaaaacacggtgctgacaagcacggtgcaaaacgtagataaagcctatacattaattgccgagcaatataataaaggtacgctcaagagcggagatcacgactttgatttcagggaaggagtcgttgaaatggggacgttcagcccgctggtggacaaagcgtttcaagacaaaatctcagaccttgtaaaaacgtataaccaaacaaatgaactgccgtcaaatgaatagaggtggatacacatgcagcatgaaaagtctcttgaatttatgcagatcgcgatgaaatacctgccggaagcaaaggcggagcttgagaaatccggcatagatctgtctatggaaatgattcagccgtttatggacctgtttacatcggtcatggcggaagcgtatgagcttggcagatctgatgccggggagctgaataaataaagagagccactttttcatgaagtggcttttcacatgatttttttctttatggcggacaccatcggcgcaaagtctttaaatacgggctttaattgatccagggagttcatgatggaccccagctgattcaacacgtggttgtaatcgatctcttcttcgttttcagcctgaggctgctccgggttttcttccggctctttatcccggtctctggaatcgccgaacatcattttggagaaaatatccatagtgaagcctcctttcgtcttccttttattctatgaggagcagcgtccgatagtttagacgaatatattgccaacagaaaaaaaatagggtagaattagtacctgatactaataattgatcataactaattagttttaaattcattataaaaaaggagtcttttccaatgaaagctggaattcttggcgtcggccgttacatcccggaaaaagtgctgacaaatcatgatcttgaacaaatggtagatacatcggacgagtggattcgtacgagaacaggtatagaagaaagaagaatcgccgcggaagatatgtattcatccggcatggccgccgaggctgctcaaaaagcgcttgatcaggccggcatttccgcagaagagcttgatatgatcctcgtggcgacggttactcctgaccagtctttcccgaccgtttcctgtatgatacaagagaagctcggggccaaaaaagcgtgcgcgatggatatcagcgccgcatgtgcgggttttatgtacggtatcgtaaccgccaaacaattcattgaatcgcaaacatacaaacatgtcctcgtggtcggcgtggaaaagctctcaagcattaccgactgggacgaccgtaatacggctgtgctgttcggagacggagccggagcggcggtcatcggaccggtcagcgacgacagaggcatactgtcatttgagctcggagcagacggtacaggcggtcagcacttgtacttagatgaaaaagggcatacaatcatgcatggaagagaagtattcaaattcgccgtccggcaaatgggtgaatcgagtgtaaatgttattgaaaaagccggcctctccaaagaggacgtagactttttgattccgcatcaggcaaacatccgcatcatggaagcggcacgggaacgtttggagcttccggttgaaaagatgtctaaaacagtccataaatatggaaacacatccgcagcatccattccgatttcattagtagaggaactggaagcaggcaaaattaaagacggcgatgtcatcgtcatggtcggtttcggcggaggattgacatggggcgccatagcaatacgctggggacgataaaaaaaggtgaggtgcacacaagatgagtaaaaaaagagtagtcgttacagggcttggagccttgtctccgcttggaaacgacgccgaaacaagctggaaaaatgcaatcggcggcgtatccggaatcggaccgatcacacgtgtggaatcggacgagtatccggcgaaagtagctgctgaactgaaagatttcaatattgaaaatcacatggataaaaaagaagcgcgaaaaatggaccgcttcacgcaatatgcagtcgtagccgcgaaaatggccgttcaagatgccggtctgaacatcacagacgagatcgcgccgagagtcggcgtttgggtcggatccggaatcggcggtcttgaaacgcttgaatcccaattcgaaatcttcctgacaaaagggccgagaagggtcagcccgttctttgttccgatgatgattccggatatggcgacaggccaaatctcaatcgctctcggagcaaaaggagtcaactcctgtacggtgacggcatgtgcgacgggaacgaactctatcggtgacgcgtttaaagtcattcagcgcggcgatgccgatgcgatgattacgggcggaacggaagcgccgctgacaagaatgtcatttgcgggcttcagcgcaaacaaagccctttctacaaatcctgatccgaaaacggcaagccgcccgtttgataaaaaccgtgacggctttgtcatgggagaaggcgcggggatcgtcgtgcttgaagagcttgagcatgcccttgcccgcggtgcgaaaatttacggggaaattgtcggctacggctcaacgggtgacgcctaccacattaccgcgcctgcccaagacggggaaggcggtgcaagagcgatgcaggaagcaatcaaagatgcgggcatcaagcctgaagaaattgattacatcaacgctcacggcacaagcacgtactacaatgataaatacgagacaaaagccattaagaccgttttcggtgatcatgcgtacaagcttgccgtcagttcgacaaaatcaatgacgggtcatttgttaggcgctgccggaggaattgaagcaatcttctccgtcatggcaattaaagacggcattatcccgccgacgattaacatcgaaacacctgatgaagagtgtgatttagattatgtaccggacaaagcgcgcgagcaggatgtcaacatcgttctcagcaactcgctcggcttcggcggacataatgccactttgatctttaaaaaatatcaataatacagtttttgaccggctgcctgaaaaaggtggccggtttttttgtgcgtgcatatgataacaacaagaggaggcgaacaggtatgagcgtcaagcagacatatcaatggatggaaaaggcggcatccgtaaatgacctggccccgcatcttttgccgcttttttcaggggccgataagaaagagtggaagccgatactcgggatgctgcaaaaccacggcatgttccgccatctgaaggacggcgttaggaccagtaaacggctgaaagaaaaaggatgctacagccatatacaaaaggaggaagcctatttaaaggagaagtggaacgggccggacgtgccgatcgtagttttgcccgttgatgaacgaaaccggaaaatccgtcaggaattcggatcaaaatccggtctggcctttcgggacaaaatgttcctctttctatcgtcggatagttccaattcagctgtatccgcccttatgacacatgaatataatcacgtctgccggttagaacatgtgacaaaggacgaaaaagatgagacatttcttgatacaatcatgatggaggggctggcagaatatgctgtatatgagcggttcggctcaagtcttacggcggaatggacgtcctactatacgcctgagcagcttgactttttgtttgaaaaaagagtcaagccgaacctccgcttaacgagagacagcagaatgttttcccagctgttatacggaaaaggatacttcccctcaatgcttggctatgccgtcggattcaatatagtaaaaaaatatttaaccgaccatcaaaaaacagtaaaagaagcattggccatcccttcaaaaacctttctggaagcaacgctttaatagattaaaagaatggaaattatttaaggatattacatttatcctaaaaaattcttgcttttgtaataatgatgtaataatatacaactataaaatttttcgactattctatattttgtgatagcgaaacgtatgtttccctctgcttcagcggaatgagaaaggggcgtatcatgagcacactattagaagtgaataatttaaagacctattttttcagaaagaaacagccgatacccgcagtcgacggggttgattttcacattaacaaaggcgaaaccgtcgctcttgtaggagaatctggctcgggcaaaagcatcacctcgctttctattatgggacttgtccaaggctcgggcggaaaaattatggacggctcgattaagctagaaggcagggacctggcctccttcaccgaaaacgaatattgcaaaatccgcggaaatgacgtctctatgatctttcaggagcccatgacttccctgaatccggtgctgaccatcggcgaacaaattaccgaagtgctcgaataccataaaaaaatgaataaaagagaagcggctaaaaaagccgtcgagcttctggaactcgttggattctccagagcggaacaagtaatgaaagaatatccgcaccgtctttccggagggatgagacagagggtgatgatcgccattgcgctcagctgcaatccgaagcttctgatcgctgatgagccgacgacggcgcttgatgtgacgatacaagcccaagtattggagctgatgaaagacctctgcaaaaaattcgatacttccattctgctgatcactcatgatttaggtgtggtttccgaagccgccgacagggtgatcgttatgtattgcggacaagtcgtagagagtgcgagtgtggaggacttatttttaaaccctcttcatccgtataccgaagggctgttaaactccataccggtgatagatggagagattgatacattaaaagcgatcaaaggcagtgtcccgacaccggataatcttccggaaggctgccgatttgccccgaggtgttcaaaagcgatggacaaatgcaaaacagggcagccggagctgataacgcatgaaagcggccgttctgtaagatgttttttatatgaggaagagggtgcccaatcaaaatgacagctgcagaccaagaaacgattttagagctgaaagacgtaaaaaaatatttcccgatccgctccggtttttttcaaaggaaagtcggtgatataaaggctgttgacggcgtttctttttcactgaagcgcggggagacgctcggcatcgtcggtgaatcaggatgcggcaaatcaacggcgggaaggacgatgatccgtttatacaagccgacagacggccggattctttttaagggtcaggatatctccggcttatctgaagaaaagctgagaaaaagcgtccgcaaaaacatccagatggtcttccaagatcccttcgcatcccttaacccgaggaaaacgctgcgttccattattaaagagccgttccagactcaccatatgtacagcatgagcgagcggaacgagcgagtggaggagctgctggcgaaagtcggccttcacccgagctttgcaaaccgctatccgcacgaattttccggaggccagcgccagcggatcgggattgcgcgggctctgacgttgaatcccgagctgattattgcggatgaacccgtttccgcactcgatgtctccattcaggcccaagtcatcaatttgatggaagaactgcaggatgaattcaacctgacctatttgtttatttctcatgatttgagtgttgtccgccatatcagcgacagagtcggcgtcatgtatctgggaaaaatgatggagctgaccgataaacacgagctgtacggcaatccgcttcacccttatacgcaagcgcttttgtcttcagtgcccgtcacgagaaaaaaagacgccgtcaagcgggaacgaatcatcctgaaaggagaactgccaagcccggcaaacccgccgaaaggctgcgtgttccacacgcggtgcccgatggccaaaccgatctgcaaggaacaaatcccggcatttgaagaagccgctcccggccattatgtcgcctgccatttatatgcctgaaatgacaagcatcgagagggggtatgccggattacataaccagtttgctgcatatatatcacaaagggggaattgatatgaaattacgtaaaagcgcactgatgatgctaagtgtttttatggcgctcgccatcttcctgtcagcctgctccggctcaaaatccacaagcaccgaatccaaaccggcaggaaaaccgcaaaaaggcggagatttggttgtcgggtcaaccggggaacccacactttttaatccactttattctaccgatgttgcaagttctgatattgaaggcatgctttacagcacattattggaaacggatgagaaattaaacgtcaagccgtcgctggctgaaaaagtaacagaagctgacgggggattaacgtatgatgtaaaactgaaaaaaggcgttaaattccatgatggaaaagagctgacggccgatgatgttgttttcacctacagcatccctcttaacaaggattacaacggtgagcgtggctcgggttttgagtcccttaaatccgtgacgaaaaaaggaaaatatgaaattcagtttaaaatgaagaaaaaagatgcctatttctataatgtcgttctcgacagttacggcattttgccaaaacatatattgggtaaggtgccggttgcagatctgggagagaatgaatttaaccgtaaaaatccaatcggctccggtccgtttaagtttgttgagtggaaaaaaggtgagtatgtcaaactggaagcaaatgatgattactttggcggcagaccttaccttgatacagtgacagtcaaaacaattcctgattctaacgcggccgtggcccagttaaaagcgggagatattgatttcttcgttgtgccgggcacagattttgatacggttaaaacgtttggaaacgtgaaggtcaaatctgatcttggcttaaactacagctatatcggctggaatgagaaaaaagagctttttaaggacaaaaaagtgcgtcaggcattgacttacgctcttgacaggcaggcaatggtggatcaagtgctgaacggagacggtaaggtagcggatgttcctgagagtccgctgtcatggaattatccgaagtctaaagtgccgacatttgattataatccgaaaaaagcaaagcagctgctaaaagaagccggatgggaagaccatgacggtgacggctaccttgataaagacggaaaaaaattctcatttgaaattaaaacgaatcaaggcaataaaattcgtgaagatttagctgttgtcgttcagcagcaattaaaagaagtgggaatcgaggctaaaccgcgaattgttgaattcagtgcgttaatcgaacagacaagtgcccctaattgggattatgacgctcttcttctcggatggagtcttgcaacgttcccggatcaattctctatcttccattcaagccaatcgaaaaacgggctgaataatatctggtataaaaacccgaaagtcgataagctgcttgaagaagcgaagacaattacagacagaaaagaataccaaaagaagtatgaagagatatacaaattgatagctgaagatcagccgtacagcttcttattctattacaattaccacagagcgatgccgaataatttacaaggctatgtattccaccctaaaaatgacttgtacaatattgaaaaatggtggctggatcaaaaatagcaaaagccctggagagggaaggaggttcctttcctctcttatcctatttaaaaaggggacaagaatatggttacatatattttacggcgaacattaatgtccttgccgattctcttaggcattacaattttgtcgtttgccatcatgaaagcagcgccgggagacccgatgtcacttatgatggaccctacaatcagtcaggcggacagggcgaaattcattgaaaaatacgggttgaatgatccggaacctgttcaatatgtgaaatggctggggaatatgctgcaaggggattttgggacttctatcgtcaagaaaggcactccggtttctgaacttatcttatcccgcttaccgaatacgattgtgcttatgcttttctcaacccttgtcgctcttcttatttctattccatttggtgttctgtcagcaaaacgtccttattcaaaattggattacgggataactgttacttcatttttagggcttgccattccgaatttttggttcggtttgattttaatcatggttttatctgtaaatctggggtggtttcccactggcggagtaagcactttgaatgctgactttaacatatttgaccgattgcatcacttgattttgcctgcttttgtgctcgccacggcagacatggcagggataacgagatacacaagatccagtatgcttgatgtgttaaaacaggattatatacgaacggcgcgtgcgaaaggattccgagataataaagtgatttttaaacacggtttgagaaacggacttcttcctgtcatcactatttttggtttgatgataccgtcatttatcgggggagcggtagtggtagaacagatttttacttggccgggtctcggcaaattgtttattgattcagccttttcgcgggattatccggttatcatggccatgacggtcatttcagctgttttggttgtagtggggaatttaattgcggacatcttatatgcgctggttgatccccgcattgaatattaacaaggagaggtgagaggtcaaatgttacagccaaataccggcacaccccccagcgatgtgaaattaaaggaaaatattcaatccaaaccggaaacaatgacgaagatttttttcgaaaagttctttcaaaataaactagctgtaatcggagccgttatattaaccatcattatcttgtcagctttattcgcttcggtaatcgctccttactctccggagagtcaatctctcatcaatcgtttgaagccgccgagcttaaaacatctaatgggaactgataaattcggaagagacatctttacgagggttctgtacggggcgcgcgtttccttgcttgtcggattcgcttctgtgatcggcgcgattacaatcgggacagttgtcggagccgttgccggatattttaaagggattgtcgatgccgttctcatgagaaccgttgatatcgtattatccatacctgatatatttttgcttattacacttgttacgatttttcagcccggaatggataaattaattttaattttctcccttacaggctggacaacaacggcacgccttgtccgaggggagtttttatcgcttcgttccagagagtttgtattagctgcaaagacgatcggtacaaaaaatcatcacatcatcttttctcatatactgccgaatgcgctcggaccgattattgtctcagccacattaaaggtgggaacggttattttggcggaatctacattaagttatctcggtttcgggattcagccgccgatcgcaagctggggcaatatgcttcaggatgcacagaactttacgcttatgattcaggcttggtggtacccgttattcccgggtttgttgatccttcttaccgtattgtgctttaactttgtcggagacgggctgcgtgatgcgcttgatccgaaaaatgtgaaatgatctcccggacggaacgggagatttttttgttgcaatgcagtcggaaatccagctccgtaatacggaaatctcatattgaaatggaataatttatctatcccttgcctatactgtggacaacagtttttataaagtgaggggtcgaatatgttatttcttcatgatgtatgggtcaattggtttgaaggggaagaaaacggctacaatgtatgccattttcacgaatggcggaaggaagacacggttgagcttttggatcagacgccgctgctcagagtgccgtcggtattatttcattacatagaaaacgacttatcagagcttccgaaagagctgcttgaccaagtccaccagaagtcatacgtgcgaaaaaatcatgagcggacaaaactggagtactgttttgtcgtgacagacgggatcggcatcattgccgtagatacgatcgggtataccattccggtcagaaagagccgcctgattccgagacaggagcagcttgtttatgaaatggtaaaggatgtagaaccggaatcgtttcaatttgacccgtcgcaattggagtcttcaaaggaatatcacattttgtcattggcgccggagcatgtcagaggtctgacgagaaaagagcggcagatcaagcagctgatgtttatggcgctcgaccagctgaaagggctgaaaaaccgtgcggaaattgtgtattggtacacggaatggaatccgcatatgtatgagcagatcaaacggatgagttttgaagagatctgggacatgctttacaatgaaacaattgaaggctggtcggataaacatcttgcgttctgtgaaaatttgattaaagggcagccgtttttcgaaaagctttgggaaatggaacaggaatcaaaagtgaactaaaaaaagaggcggagattctcccgcctcttttctttatcttcttttccgtccgagacccatggcgttttccattttcttcaccattttgccggccgttttgtttgcgcgcgccgccccttcgtcgagaatgcggtcaagctcgtcgctctcaattaattcacggtagcgctcttggatcggtgtcaatgcgccgataacgacttcggctaaatcgcttttgaattcaccgtaccctttgccttcatatttagcttctaattcttcaattgatgtgtttcctaaaatagaatagatcgtcaaaagattagaaatgcccggtttgttttctttatcatactttacaatgccttcagaatcagtcacggcgctcttgattttcttctcgagctgcttcggctcatcaagcagcgtgatgaatgccttttggttcggatctgatttgctcatttttttgagcggatcagccagtgacatgatgcgcgcgcctgattcaggaattttcacctcaggaatcgtgaagatgtcattgtattttttattaaagcgttccgccaggttgcgggtcagttcaagatgctgtttttggtcttctccgaccggaacaagatccgttccgtacagtaaaatatcgccggccatcagcggcggataggttaacagtccggacacgacggcttctttgccctttgacttatccttaaattgcgtcatccgctcaagctcgccgatatatgcgacgcattggagcatccaccccgcctgggcatgagcgggaacctccgactggataaagagggtcgctttctcgggatcaagtccgacggccaggtaaagagccgcgagattgcggatgttcttccgcagttcaagccgatcctgcggaaccgtaatcgcatgctgatcgacaatacagaagtagccgttgtagtcatgctgcaaatcaacaaattgcttcattgcgccgatgtagttgccgagggtaacggaaccgctcggctgaatgcctgaaaaaatcgttttcttcatagttcttacctcatttcttaaaacataataaaaaaagcccattcttcccgtagaaaaaagggacgaatgaaccgtggtgccaccctgattattccattacaatggaatcgctcgagacgttggtaacggaggctgctccggctgggcctactaacgttcggtcagctgctcagaagtccattccacatcgcccgttacctgctcccagcaccgcagactctcttcaaacggatgaaaatgtgtactactcttcatcatcgcaatcacaacaaatgtatttgattgatctattataaatcaattatagccaaatgtcatcagaggaatacaagcttatttccagtttgctttaggggtggaaatcctcaaaaagaactgaaaatgcttaaatgataacgtatatcaacatttcgtataacgaatattatatgtaaaaagcaatatgaactggaaattacatttaaaaaatttagttaggtcatgctttaaactatagaagtgcatcacctttttgacagaaaaactgaccaaatttaaatattttaaattgagaaaatagtattgcaataaattattcatttcattataatgaacttgttcactctattgttacagcttctttacataaaataatcagaaaagacggaacacaattaaagtttagaaaaatattaagttattttgtctgatatttctgagtatttagtagtaaaggctgaaaaatttgattagggggttagtgcatgaaaaagcgttggtctattgtaggtttgatgcttatcttctcgcttgtattaagtgcgtgcggcggattcagcggcggatcaggcggcggtaaaaaagacaccaaaggacagacttcacttaatatcaatattaaaaccgagccgttctcactgcatccgggtttagcgaatgattccgtgtcaggaggcgtaatccgacagacttttgaaggattgacacgcgtaaactccaaaggtgagcctgaagaaggaatggcatctaaaattgaaacaagcaaagacggaaagacctatacatttacgattcgtgacggtgcgaaatggtctaacggcgaccctgtgacggcgcaggattttgaatatgcatggaaatgggcgcttgacccgaacaacgaatcacaatacgcttatcagctctactacatcaaaggcgctgaagctgccaatacaggaaaaggcaagattgatgatgtaggcgtaaaagccgtaaatgacaaaacattaaaggttgaactgaataacccgacaccttatttcacgcaattaacttcattctatacgtatatgccgatcaacaagaaaatcgcggaaaaacataaaaactggaatacaaatgcgggcgaaaattatgtgtcaaacggcccgttcaaaatgacggcctggaaacacagcggttccatcacgctcgaaaagaacgatcaatattgggataaagacgctgtgaaattgaagaaaatcaatatggtgatgattaacaataacaacaccgaactgaaaaaattccaggccggtgagcttgactgggcaggaatgccgctcggccagcttccgactgaatctctgccgacattgaaaaaagacggatctcttcacgttgaaccgatcgcaggcgtgtattggtacaaattcaacacagaagagaaaccgctgaacaatgtcaacatccgtaaagcccttgcttatgcgatcgaccgctcgtccatcgtgaaaaatgtaacgcagggcgaacaaatcccggccatggctgcggtgccgccgtcaatgaagggattcaaggataacacaaaaggttatttcaaagacaatgacgtcaaatcagctaaagaattcttaaataaaggactgaaggaattaggcgtcaagaatgcctctgaccttccggcgatcaaactgtcctacaatacggatgacgcgcatgcgaaaatcgcgcaggccgtacaggaaatgtggaaaaagaacttgggcgtcaaagttgagcttgataactccgaatggaatgtttacatcgacaagctgcacagccagaactaccaaatcgcgcgtatgggctggctcggcgatttcaacgatccgatcaacttccttgaattgttccgtgataaagaaggcggaaacaatgataccgggtgggaagatcctgagtttaaaaagctgctgaaccaatctcagcttgaaacggatccggataaacgtatcgaagagctgaaaaaagcagaaaagatctttattgacgcaatgccggtcgcgccagtttatttctatacggatccttgggtgcaggataaaaacctcaaaaatgtgatcttgacaggaacaggcgaagtttacttcagaaacgcttcttttgaataaaagccggttctgaaaacaaaagacccaaggtatatggggaggatgtccccatatacctttcttactgattacgtataaaattgtaaaaaacatggaggtgttcaccttgctgaaatatatcggtaaacgattcatttacatgatcatcacattgtttgtgattgtgaccgccacgttcttcttaatgcaggcagcgccgggcggaccattttccggcgaaagaaagctgccgcctgaaattgaggcaaacttaaacgaacactatggtttggacaagcctcttttcgttcaatatgtcagctacctaaaatctgtggcgatgtgggacttcgggccttcttttaaatataaaggccaaagtgttaatgatttaatcaattcaggcttccccgtctcattcactctcggtgcagaagctattctcctcgctttagcgttcggtatgcttttcggggtgcttgctgccctgtaccataataaatggcaggattataccattgcgattttaacgatctttgggatctcagttccgagctttatattggcgacgattttgcaatatattttctcaattaaattagaactgttcccggtcgcagggtgggaatcctgggcatacacctttctgccctccattgcgctcgcttccatgccgatggcgttcattgccagactctcccgttcaagcatgattgaagtgttaaacagcgattacatacggactgcaaaagctaaaggactttcccgtccgtcagtcaccgtgcgccatgcgctgcgaaatgcgcttttgccggtcgtgacatatatggggccgatggcggcatccattttaacgggaagtttcatcattgaatccattttcggaattcccggtttaggcgcgcattttgtaaacagcattacaaaccgtgattatacggtcattatgggagttaccgtgttcttcagcgtgctcctgcttctatgcgtattaattgtagacgtgctgtacggattaatcgatccgagaatcaagctttccaaagcaaagaaaggagcctagaccatgcagaacattcctaaaaatatgtttgaaccagcttcagctaatgccggcgatgccgaaaaaataaataaaaaaagcctttccctctggaaagacgccatgctccgcttccgcagcaataagcttgcgatggtcgggttcgtactgatcgttcttattattctgatggcgatttttgcgcctatcttttcaaggtatgattatgccactaccaatctattaaatgcggataaagcgccgtcgaaagatcattggttcggcacggatgaccttggaagggatatattcgtccggacatgggtgggcgcgcggatttccatctttatcggtgtcgcagctgccgtgcttgatttattgatcggcgtaatctggggcagcatttccggattccgcggcggacgcacagatgaagtgatgatgcgcatcgccgacattctgtgggctgttccttcattattaatggttattttgctgatggttgtcctgccgaaaggattgctcaccattatcgtcgccatgacgatcacgggctggatcaatatggcgaggatcgtccgcggacaggtgctgcaattaaagaatcaggagtatgtgcttgcttcacagacactcggtgccaaaaccggccggcttttgtttaagcatatcgtcccgaacgcgatgggctctatcctcgtaacgatgacactgacggttccgaccgcgatttttacagaagcgtttttaagttatttgggcctcggcgtacctgcgccgcttgcgagctggggaacgatggcctcagacggattgcctgcattaacctattacccttggcgtctgttcttccctgccggctttatctgcctggcgatgttcggctttaacgttgtcggcgacgggttaagagacgcgctggatcctaagttacgcaaataaggagtgatatgagtgacacgtttgctagaagtaaaagacttagccatttcatttaaaacatacggcggagaggtacaggcaatccgcggcgtcaatttccatttgaataaaggagagacgctggcgatcgtgggggagtcgggttccggaaaaagtgtgacctcccaagcgattatgaagctgattccgatgccgccgggctactttaaaagaggacagattctttttgacggacgtgatatcgtgccgatgtccgaaaaagaaatgcagactataagaggaaaggacatcggaatgattttccaagatccgatgacctctctgaacccgacgatgagagtcggcaaacaaattacggaagtgcttttcaaacatgaaaaaatctcaagtgaagcggcgaaaaagcgcgccatagagctgcttgatctcgtcggaattccgatgcccgaaaaacggatcggccaattcccccatgaattttcaggcgggatgagacagcgtgtcgtcatcgcgatggcgcttgcggcaaatccgaaactgttaattgccgatgaaccgaccacagcgcttgatgtgacgattcaggcacagatccttgagctgatgaaagatctgcaaaagaaaattgatacgtctatcatttttatcacgcatgatctcggcgttgtcgccaatgtcgccgaccgggtcgccgtcatgtacgcgggtcaggtcgtcgaatcgggcacggtggatgaaatcttttatgatccgcgccatccgtatacgtgggggctgcttgcctcaatgccgagtctggacagcaccgatcaggaaaaactgacggccatcccgggcacgccgcctgatctgacgaatcctccgaaaggggatgcatttgcgctccgcagctcatatgcgatgaaaattgactttgaacaggaaccgccgatgtataaagtgtctgatacgcattttgtgaaatcgtggcttctgcatcctgatgcgcctaaggtcgagccgcctgaagcggtgaaggctaaaatccgtcagcttccgaatacgtatcagcatcctgttttaatgaaggaaggtgaaaaaaatgactgagaaacttctcgaaatcaaacacttaaaacagcattttttcacgcagaaaggaacggtaaaagccgtagatgatttgtcatttgatatttataaaggtgaaacgctcggccttgtcggagaatcgggctgcggtaaatcaacgacgggccgcagtattatccggctgtatgaggcaaccggcggggaagttctctttaacggggaaaatgtccatgggaaaaaatcccgcaagaagctgctggagtttaaccggaaaatgcagatgattttccaggatccgtacgcatctttaaatccgagaatgacagtcgccgacattattgccgagggaatagatattcaccgcctggcaaaaacgaaaaaagagcggatgcagcgggttcacgaactgctggaaacggtcggtttaaataaagagcacgccaaccgctacccgcatgaattttcgggcggacagcgccagcgtatcggaatcgccagagcgctggcggttgatccggagtttatcatcgcggacgaaccgatttcggcgcttgacgtctccattcaggcgcaagtcgtcaatttaatgaaagaattgcagaaagaaaaagggctcacttacctgtttatcgcccatgatttatcaatggtcaaatacatcagcgaccgcatcggcgtcatgtatttcggaaaattggtggagcttgcgccggcggatgagctttacgaaaacccgcttcacccatatacgaaatcattgctgtccgctatcccgctccctgatccggactatgaaagaaatcgcatgcgaaagaaatacgatccggcagttcatcagctccaagaaggagaaaaaatggaattcagagaagtgaaaccgggacattttgtcatgtgcacagaagctgaatttaaaacctatctataaaagtatcatcctccaagactcagtcttggaggatttttttgcgcacattcaagtttattaagcctgctcccgtttttctataatggaaaaaaagggggagatcagtatgaaaaccattttgtgcgccatttgtgcgggactgtttatcagtgcagccgcttatccggcccgcgccgctgtgaaagaggagcagccgcttgtaaaaatagcgctggctgaaaaagaactgccgaaatcaaatgcacggttcgcttatccgtcagggctgcattttacacatcctgataaggtgcggggcatttacgtcacaggacattcagcgggaggaagcaaattcggggagctgacagactttgtggacaaaacggagctcaatacaatggtgattgatgtcaaggacgacaacggaaacctcacctttaagccggacagccattctgagtatgccaaaatcgccaagccgtacatcaaagacccaaaaaagatgatgaaaaagctggaggaaaaaaagatttatccgatcgcgcgtattgtcgtatttaaagacagcgaactcgcgaacaaaaagcccgagtggtcctttaaagaaaaaaacggaagtgtctggaaaaacggccgcggagaatcgttcgtcaatccgtttatgaaagaagtatgggattacaatgtaaagattgcaaaacaagccgtaaagatggggtttcaagaaattcagtttgattatgtccgttttcctgaagggtttgaaaaacgtgatgacgaactgacatacggtcacggcgattacggaaaaacagcagacagcaatgtgcaaaaacgcgttcacgccgtcaccgattttgtcggttatgcgaagaaaaaactcaagccgtacggcgcggatgtgtcggttgatattttcggctattcagccacgctgccggaagcgcctggtatcggccagaatttcagcaaaatttcagaccaggtcgatgtcatttcatccatgatttatccgagccattggacaagctatttcggcattgataaaccggatcttgagccttacaatgtcgtcaaagaatatgcgaaggtggaaaataaaaagctgtctaagctgaaacacccgcctgtatcgcgtccgtggcttcaggatttcacggcatcatatctcggcagcggaaattatcaaaagtacgggaaacgccaggtggaagaccaggttaaagcgctgcatgatgaaggaattgacgaatttttattgtgggacgcggcaaaccgttataccaaaaacgtcgattacacaccattttaaaaaaattgaaaccatgttaagggatcacacgtcttaatagatgtaagattgtttaaacaatcggaaatggggtatatctaaaagtgtgaagacaacgaacccataaggagcaaatgaatgaactggtacgaaaagctgagtgaatattttccgattgaagaaatgaaatcaaaagcgcatatggaagctctgttaaaggagcaaagcgatgtttatcataaagaagaggggcagtaccacgtgctgatgtatgcggaatttgactctttcatctttattgattacctgtttgtgtcaaagaaatccagaggacaaggcctcggaagcaagctgatcggcagactgaaaaagaagaacaagccgattctgcttgaggtggagcctgttgacgaggatgacacggatacacagaaacgcttgcgtttttatcaaagagagcatttcaagcacgcgcagtcaatcgggtatcggcgccggtcattggctacgaatgaagtgaacaaaatggagattctgtactggtcacctaagacggaatcagaagaagaaatatttgaagcgatgaaacagacatatgaaaacattcacacttataaagatgaaaaatggtacggagaatcatacgaaaaaacggatgaagttctcaaagtcattgatgagaaaaaacaaaaaaacattttcgatcagctgagctaattgagaatggggaaaaatccgccagccgtaaatttgccggattgacacatttttttctcaggagactgttcacacttacttttttatagtataatacctataaagattccttttttaaagtcatttcaatttgagaatacaaacatgttcatcctactaattagaggagtgaagattaatggttacattatacacatcacctagctgtacgtcatgcagaaaagcaagagcttggcttgaagagcacgagattccgtttgtagaaagaaacattttctccgagccgttatcaattgatgagatcaagcagattctgcgtatgactgaagacggtacggatgaaattatctctacccgttctaaagtattccagaaactgaacgtaaatgttgaatctatgccgcttcaagacttatatactttgatcaatgagcatccgggactgctccgccgtccgatcatcattgatgaaaaacgtctgcaagtcggctataacgaagatgaaatcagacgattcctgccaagaaaagtgcgttctttccaattaagagaagcacagcgtcttgctaactgatataagcttacgataagcatggaaaaagcccaaaaccatcgcggtttgggctttttgttatttttcagtctgctggtaaatcatactggcgaggataacaaaaacgacggtcaaaatcggcagcatcatctgtagcatgccgtgttctgccatgaaaaatgacagcttgctgtctccggcaatcatttcaccgccggtaaatgcgagaaggccgctcccggcatacatcaataaaggcattttttccatggcggcatgaacgagcttgctgccccaaataataatcggcaccgagatgaagagaccgatcactactagtgtcagctcaccgtgagaagcgccggctactgcgatgacattgtcaagcgacataaagatatcagccagaacgattgtgcggatggctttccaaagagaagaactgctttttacatgctgtgcatctttcttctcaatcagaagctgatagccgagatacaataaaaataccccgcctgcgcattgtaaaaaaggaacattcaataaatagaccgcagcgctcgtcagaacgattctcaagacgactgcaataaatgttccgaagatgatcgcttgctgtctttgtttatgggccagattccggctggccatcgcgatgacgacggcattgtcaccgccgagaataaggtcaatcccgataataagcagaagggacagcaggtaatcgtgcggcatggtaacacctcgcttatagatcgattgcttgtacagctaatatatgaagcagtgcgctatttatgatgggaaccgggagaaagcctgtttttcagtgtgaaaatgcttttttatttcttttataactgttttatcataaaatagaaatataaagaatttgcgctgtcttctataaggttaagatgtggacggaatgggtaaagtgtagtaaagtactattcatcgggagcttagatgtcccttcaacatcttataaagaagggaaggttggcaaaatggaaatagaaagaattaatgagcatactgtaaaattttatatgtcttatggtgatattgaagatcgcggttttgacagagaagaaatctggtacaatcgcgagcgcagtgaagaactgttctgggaagtcatggatgaagtgcatgatgaagaggaattcgctgtcgagggtcctctttggattcaggttcaggcattggacaaaggactggaaataatcgtaacaaaagcccagctttccaaggacggacaaaaactcgaactgccgatcccggaagataaaaaacaagagccggcagatgaaaatctcgatgctttacttgatgatttccagaaagaagagcaggccgagagccgggaagataaggagcaaaagcttcagttcactttgcggttcgatgattttgaggatctcatctcgctatcaaaattgaatcttaacggaatcaaaacgaccttgtattcgtttgaagaccgatattatttatatgcagatttttatgagcaaactgatgaagaggttgaaaatcagctaagcatcctgttggagtacgcgcacgaatcatcagtcagcattcaccgtcttgaagaatacggcaaattggtgatcgctgatcatgcgttatatacaataaaaaaacactttgcatcataacaaaccgatttctctcagcagaaatcggttttttttgttctgaatgacaggatgaacggctgaaaaccgtataacggctctcatccgcaaacaggattatgccttcttcctgctgaatacaacaagattcaggaaaggagaagatgcaacatgttcagtgctgtgactgccgacggacggctcattcagctggccggaagctattcaaaggaaaaagcggcggagctgagaaagaaacgctggttctgccccgtctgcaaaagtgagcttgatatcaaactgggacgggagaaactgccgcacttcgctcataaaaaaagcaggctgtgtcccggggaatccgaacctgaaagcgaataccatctggaaggaaaaagacagctttttctctggctgaagacacaagggtgcagtgtcagcctggaaccgtatctgacttccgctggacagcggcctgacttgacggcagaaagcggagaagagaggctggcttttgaatttcaatgtgcgaacctttcggcggactctttaaagagccggacggcaggcctgaaaagtgccgggtaccggccggtctggatcatcggggcaaaacggttaaaacggatggctgcgcaatttttccggctttctgcttttcactggcagttctttgaagtcaattcattttcctccttaatgttttactgccccgacgtccgctccttttacaggctgcattccatcactccgttttacaccggctattcttatgccggcttaaccacaatccctcttcacaaagcaaacctgaaagacatttgtcatccggaagggcggcacagcgtcagacttccctcgtgggggcgtgccgttgccggcttccgcagcaaaagcgggcggtttttatctgaagatgccggtcttatccggcgtcttttttacgaaagacatcaggttgcatttccatttctcccctctgaagtgtttattcccgtttcagcaggctttgtgtttgcaagtcccgtttttgtgtggcagggccatttatacatgcggcttgcggaactttctaaaaaaggcgctccgatccgattatccggcatggttcatgatttacggcaaaaaatcaggcataaggagatccggatgcggtatggttcacaagacagccttatcggaatggcggtaaaacaatatgctgatttcttatgcttgcaggattttttaagggaaattgagaatgaagtatatatgccctcatctcagcagaagcgccctcaaacggcagaagagctgcgccggcgggacctgctcttttttggggaatgagaatgcttcatttcgttcaccctaacgtcaaggtggtggcgaatgtgaggggcgtacaagcattttgttttcgttttttcactgtattattggtatgctcggtcttatatgccgcatatgatttgacaaaaggcagtgaaaagccggaagataatcacaacacaagtttttggagaaacaatcgttttttcaattggcttgaagtaaagaaaacgagggggatcaccatgactgaggaaaataaagcagcacagctgcctgacagaagtgaagtaaaggcagagcatacatggagactagaggatatttttcctagtgatgaggcctggaataaagaatttcaagcagttaaagaattaattccgaatttatcttcttttaaaggcacgcttgctcattcggctgataatttatacgcggcgcttacggcacaggatgaagtgacgaaccgccttgggaaactttatgcatacgcacatatgcgctcagaccaggatacgggaaattctttctaccaagggctgaacgacaaagccgcaagcctgtattctcaggctgccagcgcgactgcttacattgaaccggaaattctggcgattcaggaggacaagctgcaccagtttattctggaaaaagaggagcttaagctttactcccatgcaattgaagaaattacaaaacagcgtccgcacgtgctgagcgaacaagaagaggccctgcttgcggaagcctcagaagcgctatcgtcaccttccaatacattcagcgttttaaataacgccgatattacgtttccgtcgattaaggatgaaaacggcaaggaaactcaaatcacacacggcaactttattaatttcctggaaagcagcaatcgtgaagtccgcaaaaacgcatttgaagccgtatataaaacatacggacagtataaaaacacgatggcgactacactcagcggcactgtaaaaaaagataatttttacgcccgtgtgaaaaagtataaatcagcacgggaagcggctttatccaataacagcattcctgaagaagtttacgataaccttatcaaaacgatcaataaacatcttccgttattacaccgttacattgacctgcggaaaaaggtgctcggccttgatgaagtccatatttatgacctgtacacaccgcttgtaaaagattcgggaatgaaggtcacatatgaggaagcgaaagattatatgctcaaaggacttgctccgctgggcgaggaatacgcgtctattttaaaagaaggacttgaaaaccgctgggtcgatgtatacgaaaacaaaggaaaacgcagcggtgcttattcgtccggtacatacggcacgaatccgtacatcttaatgaactggcatgataatgtcaataatctgtttacgctcgttcacgagttcggccattccgtgcacagctactatacgagaaaatatcagccgtatccgtacggtaactacagcatttttgtcgctgaagtcgcttcaacgactaatgaagcgctgctcggtgaatatatgctgaacagcttaaaggatgaaaaacagcgtctgtacctgctcaaccacatgcttgaagggttcagaggcacagtgttcagacagacgatgttcgctgaatttgagcatctgattcatacgaaagcgcaggaaggcgagccgctaacgcctgaactgctgaacgaactttattatgatctgaataaaaagtatttcggtgacaacatggtgattgataaagaaatcagtctggaatggtcaagaattccgcatttctattacaattattatgtgtatcaatatgcgacaggctacagtgcggcccaagcgctgagcagccagatcttaaaagaaggcaagcctgcggtggagcgctataccgaattcttaaaagcgggaagctcggaatatccgatcgacatactgaaaaaagcgggagtcgatatgacatcgcctgaaccgatcgaggcggcctgcaaaatgtttgaagagaaactgaacgaaatggaagagcttctttcgaaagtgaacccttcgtaattcaaaaaagcctgtgcattagatgcgcaggctttttctaaaaccccttaaacgtttttcggtgattcagccggtacaaggcaaacaatatggacagaaacagcaggggagatgtaatgtaaatcggcagcatgtgcatcatggccagcaggtttaaaaagaagaaaaacataatcattccgatgatcaatacggtgcggagcattgatttccctccttgtttatgattgatatattctatgaaaacaagcagtcagttatgttttgtgacaaaaatatgaacattaatcttatggcttgtcaaaactcgacaagatttgatatgataaggatgtgaaattgatcacaaacaaacattacccctttgtttgaccgtgaaaaatttctcccatcccctttgttgtcgttaagacatatgaaaccgcgcttatcccggcgcggtttctttatttgcacaaaaaaagccggctccgtaaggaatcagctttttttaatggtcacaacaggtgacatcctcctgggtgccggccagagatttccaaaacagaccgtgctttgcttccactctggcgacctttttggcgaatgccagttttttcatttctttttcaacttcttctagactcaaatcataaacgagtgcgatttctttcgatgcgacaaaccggaaatattcaatgaaacattccaaaggcggcgtttcagaaggcttcggttcatccccgagcatttcgaataggatctcttcgtatacgtcataagaatagttgccgggaaccttcagcccttcatcatcatgcagactgttaaagaacgtcaatgtcgggttgacggtgacgtccatttccgccgcgattttcatatcgcactgaagcgcttttaccgcgctttgcgaatggaggtcgcgcttgaattcttcaacatccaatttcgtcttttcggcaatttctaaaagaacgtcttcatccgtaatattctgcttggagacaaacaggctttcctgcatgctgcggagaaacagaatgcccgcttttcttccctgcagttcggccgcttttaaagcgagtgcggcaaggtagggcgatgaaagaggctgatcctgctcaagccaaaggcttccgtcacagggcatcccggaacggttcgcaattttttcccaagcttcggcaagaaggtgttttttccgcttttgcttattcagcgatgtaatgctcgcggaaacaatgatccgcagggtgaaaaaacgtccgtatttgatttttaatttttttatggcgggctccagcgaccagcattcaggacataaagggtcgacaaacatgtaaatttcgagcggtttttttggatgtccgtggcaatgggcgaagtattgctcatgctgataattcgtcaatatgatcgatcctccgcttctgactggtttaccatatgcctggccgtcagttccagacgcccgtacagaaattcacgaatatcgccctccagcccgacctgatccatcgctttgctcatacagcttagccacgcatcagccctctcgtccgtaatcggaaaggggagatgccttgccctgagcatgggatgtccgtgctcttcagtataaagaggaggtccgcccaaatactgggttaaaaattgcttttgttttctggccgtttcagtcaaatcacttggaaatatcggcttcagcaagggatgagacgagacacgctcataaaaagtatcaacaagttgcgatagaagttcctctccaatcgcttcatatggtgcgttaaacgattgtcccatgttgactactcctttatatggctaataggaatcataattcccattgcgaatttatctttcagttttactatcttcagttactgtatattttagcaataacattttatttctacaaacaaagtgcctttctgtcaggcgcttgtatttcatatcatatcacatcgccttcattcatgtgtaagatttcactccgcaaaaaaaccagagggcgaaggaagcctctctggtttacgcgtaatactgccgggttatgtttttgacatattgctgtgtttccttaaacggcggaatgcctccgtaccgatctacgttgccggggcctgcgttgtaggcggctaacgcgagagatacatttccgtcgtatttcgtgagcatctgctttaagtactttgtgccgccctcagcgttctggacgggatcgagcgggtttgacaccccgagtgattctgccgtggaaggcatgagctgcatcagtcccattgcccccgcaccgctgacagctttcggattaaagcctgattcctgtttaataaccgcgcggatcagtttttcgtccactccgtatttttcggctgctttctgaatggcgctgtctattgaaaagtttccggtgctgatgtcagaagccgcatccggagactttatgcccgcggaagctgccgcggaaccggatgaaacgggaattctcggtgaatatgaagcgtgagcggtccgcacaccgtttaaaattcccgattccggctgctgccggacggctgtgtccgtatactggctgagcagcgcgctgaaattggcaagcgggctttctgaagattgtccgcctgaagccgtgtttgtatgagagattgattgcagcgccattgactgcagctggagaagggccgcccaattcgttatattcactgtgtcattccacctttttttgtttctgttcataaaaacgctggattttatttttcgtgatccgctctgggatgccgaattgcttgagcaattgttcaaacgcccgttttccttcatcccagtcagcagcctcgaattccaattcaaagtcttctttctctaaatatcggctgtgatctaaaatgattaagcctttttctgattctttttccgcgcgtgcggtcgacagcgttccgaagcagcaaatgtgttctgaacggattcctagaccgtccagctgccgtttgacggggccatccggaatcttgaagacgtcaagatccggtgccgccgcaagctgttggtgcgtttccagcagaccgaccgcggcaggttcttttaaagtcagaacgaacgagccgtctttttctcggatgcggagtgctgattttttttgtttcagggaaaaatctttcgtgtcgaaataatgattgacctgctgtttaaaatcatgttctttcatgcagagtgcttcacccagcttcagaaattctgattttgtcagcaggtttttgaattcaatttctatttcttgggtcatgacagtcttcctttcaggacgaaaaaaattgtataattcccattatctctttagaggttacgtttatcaatatcgaccttgatatgataaaataaatgctgtactttgttaaaaaaggagaacattatgcaaaagagaattgaaatccagaatgcatcattaacagaagacgcgctccgcttgaagtgcggagaagacttaagcggagcggaacgcaaagcctcaggtcaaatgcttgttgattccgatcactttgcttttgtatacatacttgaatcagctgactcttttgaatatgtcattataaaagaacatgtctggccggatctgaaagaagccttagaccaaggaaaaccggcggtccttgaggccggcggaaaaacggttgaactttcagggctgcatgaagaactcgattatcttcttgaaaatattaaagataatgcaaactacggagatatggaagaaaaagtgaaaaacgtatttctttagaacaggttcggaattgggggatgtacgatggatgacaaacaatgggagcaatttctagcgccataccgccaggctgttgaagaattaaaggtgaagctgaaaggcgtcagaaccctttatgagtatgaagatgaccactcaccgattgagtttgtgacaggccgcgtgaagccggtggcgagcatacttgaaaaagcgagacgaaaaagcataccgcttcatcagattgaaacgatgcaggatatcgcggggctgcgtattatgtgccaatttgtcgatgatatccagatcgtcaaaaatatgctgtttgccagaaaagattttaccgttgtcgataagcgggattacatagcagagcataaggaaagcggatatcggtcttaccaccttgtcgttttatatcctttacaaacaacgtccggtgaaaagcacgttcttgtggagatacagattcggacgcttgccatgaacttttgggcaaccattgagcattcactgaattacaaatacagcgggaacattcccgaaaaagtgaagctgaggctgcagcgggcctcagaagccgcatcccggctcgatgaagaaatgtcagaaatccgcggagaaatccaggaagcccaagccgcgttctcgcgaaagaaaaaagcgggagaccgccagtaggaaaggaggggaatggcatgaaatttgccgtttcttcaaaaggagacgaggtttcagatacactgaaaagcaaaatacaggcgtatttactcgattttgatatgaccttggatgaaaaagagccggaaatcgttatttccgtcggcggtgacggaacgcttctttacgcatttcacaggtacagcgaccgtcttgataaaacggcgtttgtcggagttcacacggggcatttgggtttttatgccgattgggttccgcaggagatagaaaagctcgttctggccattgccaaaacgccgtatcataccgtggagtatccccttcttgaggtgattgtcacttatcatgatgaagagcgtgaggagcggtatctggctttgaacgaatgtacaatcaaaagcatagaaggcagtctcgtcgctgacgtggaaattaaaggccagctgtttgaaacgttcaggggagacggtttatgtctgtccacgccttccggaagcacggcttataataaggcgttaggcggcgcgatcatccacccttccatcagggcgattcagcttgcggaaatggcatccatcaacaacagagtgttcaggactgtcggctcgccgcttttgcttcccgatcatcataactgtgtcatcaaaccgagaaacgacgtcgactttcaagtcacaattgatcatttaaccttgctgcataaggatgtcaagtccattctatgccgtgtggcaaatgaaaaagtcagatttgcaagattccgcccttttccgttttggaaaagggtgcaggattcctttatcggaaaaggcgaatagaaagaggaaacggattggacaacttttttatccaaaagaacatgactgcccgggaagccggcatgacggtaaaagaatatacggcgcagctcggcatttcaaagcggcttctcgctgacattaaattcggcgggggagacctgcttgtgaacggagagcatgtaaccgtccgcaccgtgttagcggagggagacgtgcttaagattgaatttccgaaggagcatgtgagtgaaacgcttttgcctgagccggttccgcttgatattctttatgaagatgaccatgtgcttgtggtcaataaacagccgtatgtctcctcaattccatcaagagaacacccgtcggaaagcatcgctaacggagtgatcagccactaccgaaaaagcggcgtgccatcaacggttcatcttgtcacccgccttgacagggatacatcgggggcgatgctcatcgccaaacatcggctttcccattctcttttgtcggcagcgcagaaaaaggggcttgtcagcaggcgatatctcgctgtcgtacacgggatcatgatgcagaaggaaggaacggtggacgcgcccatcggaagaaaacatgacagtattattgagcggatggtaacgccggatggacaacgagcggtgacgcattttcaaacggaaaaagcgggacatgcgtttacgcttgcagccctgcggctggaaacggggcggacgcatcaaatccgggtgcacatgagctacctcggccatccgttagtcggtgatacactgtacggcggaaaaaatgagggaattgcccggcaggctcttcacagtgagcggctttcattcgtacaccccatgaccggagaaacgctcgtttttcacgccccggtgcctgacgatatgaaaacattaattgaacacatgtaaagcccgaaccgtttatcggtttcgggcttttttcatgcctgcctgccgtgatcctcgcgaaatcgtgaagcatcatagggcattgagctttccacagagacggtttcatgctccggaaatcgaaagcctgtcagctgattgccgaagacgcagcctgtatcaatgttgatcgtacggttgacgatccgggggcgttttaccggggtatggccgtacacaacccacgctttaccttcatagtcggcagcccagtctcttctgacgggtctgccgtcgggatgcgtttcacccgtaatatcgccgtacagaacaaattcttttaccttacgcgagtatttaccgatatcgtcagcttttatgccggcgtgggcgacaacgagatcgccattatgtaaaatgtcataaagcggcgctgactcatataatcggataaattgtccggagacttccgttctgtcggcgggagacagctctttcagttcggctgccgtcgtttccagtccgtgcatcacttttacggggtttccttttaagtaacgatatagtttgttgcaatgatttcccgggacataacggacggctcctttttcatatgcttttgccacaaaacgcatcacttctacggattttgggcctctgtccgttaaatcccccgcaaagacaagcgttctgccttcagaatggacgggcgttccgtctttcacttcatatccgagcttttgcattaaggcgatcatttcgtcataacatccgtgtatatcgctgatgatgtcgtaagccattcgtgtcagcctccttattaacggttttttatttattatggggctaattcctatacctaattacgctgtttttgcacaaattaaaaaagaattaaagaaataaagccttatcacttttttttcgcgttcagccttgttagaatatgcgttatgtttttaaaaaaaagtaaggtttcgcccgcttaaagcgggcttttataacccttgttttaaggaggtatttacaaatggaacacacatcagtcgcatctttagtcgtcgttttgatcgtcgcttttttgacgccgctccttttacatcggtttaagctcagcatccccgtcgtcgtcgcggagatcatcatggggcttattatcggaaaaagcggcctgaatcttgtcgttcagggagacacgtggctggagacgctgtctgttctcggctttatctttttaatgtttttaagcggcttggaaattgatttttcttcatttgagaaagggaagaaaaaacaattcctttcgaacggcaaggaagcgcccaacacgttttctgccgcactgattatctttttcggcatctttattttatcattgctgctgtcctatgcctttgtattagccggttttatacaaaacgcatttttaatgacgcttattatttcgacgatatcactcggtgtggtggtcccgactttaaaagaagaacggatcatgaactccaatatcggccagattatcctgcttgtcgccgttatcgcggacttggctacaatgattctgctcgctttcttctcttctctttacggagaagacagcggaaatatgtggcttctgttgattctctttgccgcgggggtcgtgctgtatttcttcggcaggatctttaaacaccgttcatttgtgcagtcgatgtctaaaggcactgtgcagatcggcacgagagccattttcacactgattatcgtgcttgtcgctttatcggaatctctcggggcggaaaatattctcggcgcgtttttggcaggcgttctggtatcgcttctgtctccgaataaagaaatggtggaacagctggattccttcggctacgggtttttaattccgatctttttcgtcatggtcggggtgaaattggacatttggacgcttttccaagatccgaaaacattaacgatgattccgcttcttctgcttgcgctgtttatcagcaaaatgttcccggtgttttatttaacgaaatggtacgacaaaagaaccgtgtttgcttcgggctttttgctgacgtccacgctgtcgcttgttatcgcggcggctacgatcggagaaaggctccacattatcagcgccaatatgtccggcgcgctgactttagttgcggttattgccagcatcatcacgccgatcggctttaagaaattattcaaacggcaaagcgcgccgcaggaaaaaaagcgcattacatttatcggcgccaatcaaatgacgctcccggttacgctggaattgccagaggaggaatatgaagtacgggtcgtccatgtgtatcaggaaaatgccggggaaacgcttgcggaatccgttttttcagttgacacgatttctgattacgagcccggcacgcttgagtcgcacggtatttttaaaacggatattcttgtcgtggcgacgggaaatgaagatgtgaacgctgaaatcgccttactagcgaaagagaaagggactgagcgtatcatcgcaagcgtcggctcggttgagcatgaaacaaaactgaaagaagagggcatcagtattttttctatccttatgtctacaaaaacgctgctgcgcgcgttaattgaggcgccgggcgtgatgagcctcctgacgaatgaggagtcttcgttatatcagatcaatctggaaaacccggcgtataacggcatcattctgcgggaatttccgctgatgggcgatgtgattttcgtccggattttcagaggtgtggacagcatcgttccgcacggagacacgcggctgaaaacaggagaccgtctcatcgtcacgggctcgcgcaactacgtgtcggaactgagaaaaatccttgaagcttgaccaaattgcaattcgtgataatatagaaggcataacaaataaatcattaatcgtatgaccactaggggtgtccttcataagggctgagataaaagtgagacttttagaccctcataacttgaacaggttcagacctgcgtagggaagtggagcggtatttttttggggttccttttatccatttaaattccaaaccacttttccgatgcgggaaagtggtttttttattttatcaggggggaagacatgatgacattttctgaagaatgcagacaggcggctgccgaatggtgggacggaagttttgttcatccgtttgtaacgggaatcggtgacggaagcctgccgattgaccgtttcagctattacgtgctgcaagattcctactatttgacgcattttgcaaaagttcaggcgttcggcgccgcatatgccgaagacttgtttacgacgggcaggatggcgggccacgctcaagggacatatgaagcggaaatggcgctgcaccgcgagtttacggagcttttaggaattacggaagaagagcgtgcggcatttaaaccggcaccgaccgcctattcttatacgtctcatatgtacagatcggtgatgagcggcaattttggagaaatattagctgcgcttctgccctgttattggctttattatgaagtcggcgaacacttaaaagagtgcaaaccggagcatccgatttatgaaaaatggatcggtacatacggcggagactggttcagacagcaggtcgaagaacagatcagccgttttgatgagattgctgaaaacagcacagaggaaatccgcgcaaaaatgaaagagaattttgtgatttcaagctattatgaatatcaattttggggaatggcttatcaaaaagaaggctggtccgagaaggacggaaaagaggtggaatcctttggagctgcacgcggtaactgataatcgcaaacccgttgccgagctggccgaggatattctatcgattcagcgcgaagtgagctttatccatatccgtgagcgggataaaacagcgggagagatcatgcagcttttgtcccttttgaaaaagggcggtgcggataaggacaaattgatcatcaatgacagggcggatatcgcgctttttgccaacatacaccgtgttcagcttccgtcccgcagcttttccgtaaaacaggtgcgaagcagatttccccatcttcatatcggacgttcggttcattcgctggaagaagccatccaagctgaaaaggaagatgcggattatgtggtgttcggccatatatttgaaaccgaatgtaaacaaggacttgaagcaagaggcatcagcctgctttcagagatcaaacgcacgctttccatccccgttatcgcaatcggcggaatgacactgcagacgatcggacacacaaagcaggcgaagccggacggaattgccgtcatgtcaggcattttctcagctgaaaatcctgaggaggcggcaaaacggtatgcacgcgcggtaagggaggccgattatgaagaaacactatgatacggcggtgatcggcggcggaattatcgggtgcgccatttcttatgagctggcgaagacgcagcagaacgttgtcttgtttgaaggcggagaagtcggccgaaaaacgacaagcgctgccgcgggaatgctgggcgctcatgcggaatgtgaaaaacgggatgcgttttttgattttgccatgcacagtcaaaggctgtatgaagcggcggggcaagagcttgaggaagcttgcggcattgacatcaggcgccataacggcggaatgcttaaactggcgtgtaccgaagaagatatcgcccgtttacggaagatggatgatctgccttccgtcacttggctttcagcggaagatgcccttgaaaaagagccttacgcttcaaaagacattctcggtgccagttttataaaagacgatgtccatgtcgaaccgtactatgtttgcaaagcgtatgcaaaaggggcgcggcgctatggcgctcacatatatgagcatacacaagtcacctccgtaaaacgggtgaacggagaatattgcatcacaacgtccggcggggatgtttatgctgacaaagtcgcagttgcaagcggtgtatggagcggccggtttttcagccagctcggcttgggacagcctttttttcctgtgaaaggagaatgcctttccgtgtggaatgacgataccccgctgaccaaaaccctttaccatgatcattgttatgtcgtcccgagaaaaagcggccggcttgtcatcggcgccacgatgaaacagggtgactggagcgatacgcctgacatcggaggaattgaggccgtcattgcaaaagcgaaaaccatgcttcccgccatcgaacatatgaaaatagatcggttttgggcggggctcaggccgggaacaaaagacggcaagccgtttatcgggcggcatcctgaagacagcggcatcatcttcgccgccggccattttcggaacggcatcctgttggcgccggcaacggctgtaatggtgcgggatatgatcttggggcaacaagtcaaacgggaatgggaagaagcgtttcgaatcgatcgcaaggaggctgttcatatatgatccttcagctgaacggaaaacaaattgattggaatcgaaaagaggggacggttcaggatttgcttgaatcgtaccagcttgatcaaagaatcgtagttgtggagagaaataaagaaatcattgaaaaaaagaattatgaaaatacaagtttgtgtgaccgcgatgtcatagaaattgtccattttgtaggaggcggatgaggatgttaacaataggcggaaaacagtttcggtcaagattgctgttaggaacgggaaaatatccgagttttgagattcagaaagaggcggtggccttctcggaatcagatattttaacctttgcggtgcggcggatgaacatctttgaagagtctcagcctaactttctcgaacagcttgacttgtctaaatacacgcttctgccgaatacggccggcgccgcaacggctgaagaggcggtccgaatcgcaaggcttgccaaagcttcagggctttgtgacatgataaaagtagaagtcatcggatgcagccggtcacttttgcctgatccggttgaaacgctgaaagcatcagaacagctgctcgaagagggatttatcgtgcttccgtatacgtcagacgatgtcgtgctcgcaagacgtcttgaggagctcggagtgcatgccattatgccgggcgcttcgccgatcggttccggtcagggaattttaaatccgctgaatctttcttttatcattgaacaggcgaaggtgccggtcattgtcgatgccggcgtcggatcttcaaaagacgccgcctacgcgatggagctcggggctgacggcgtgctgttaaataccgctgtatcaggcgctgatgatccggtcaaaatggcccgggcgatgaagcttgccgtagaagcgggccgtctttcttatgaagccgggagaattccggtgaaagattacggaactgcaagcagtccgcgagacggtcttccggtatgacggacagatattccagacaggagctgtttcagccgatcggtccctccggccaagagaagctccggtcatctcatgccgtgattatcggcgcgggtgcgcttgggacggcaagtgcggagatgcttgtcagagcaggggtcgggaaggtaacgatcgctgacagagattatgtggagtggagtaatctccagcgccagcaactttataccgaagacgatgtcagacaggaaatgccgaaagccgcggcggctgaaaaacggcttcgatctataaatagcgatgtagaggtcgagggatttgtcatggatgtcactgcggaaaacgcacccggattgattcgtgatgcctccctcatcgtggatgccgccgacaactttgaaacgagactgattgtgaatgatgcggctgtgcagaaaggaattccctttctgtacggcgcctgtgtcggcagctacgggctctcttttaccgtcattcccggtgtcacgccgtgccttcactgtctgcttgagacattgcccttaggcggtatgacatgcgatacggcgggaatcatcagcccggctgtattgcagacggccgtttttcaggcagcagatgcgctgaagctgttaacgggcggatctatcgagcatgttctccgttcctttgatttatggaaaaatgaacggtcagaaataaacgtcgcccgtcttaagtcggctgattgtccaagctgcggcacaaacgattttccgtttttatcctatgaaaatcagacaaaagcggcggttctgtgcggacggaacacggtgcagatcagaacggggatttccgaacagtttgatctgcaaaaccttgcgggacagctcagacgggcagggcttgatgtttcagccaacccgtatttaatttcgttttgcacagacaatttcaagatggtactgtttcgtgacggcagagcattaatacacggcacaagtgatatcagcagagcgaaatccttttatcataaatggatcggataatgcgaaaggagcgaaaaacatcatgagcatatgcaaagcattgacgattgccggatcagattcaggaggcggcgccggtatacaggcggatctcaaaacctttcaggagctcggcgttttcgggatgtcagccattacagcggtaaccgcccagaacacgttgggcgttcacggcatttatccgctcacccgggaggcgctgggcagccagattgacgcggtggcggaagatttgcggcctgacgctgtaaaaacgggaatgctgtggagcgcggaaatgattgcggaaattgcggaaaaaacggatcagtacgggcttgatcatctcatcaccgatcccgtcatgattgccaaaggaggcgcttccctgctgcgtgaggaatctcaggccgcgttaaaagagctgttaattccgcgcagctatgcggtgacgccgaatgttccggaagctgaggtattgacggggatggaaatccgcacgtttgaggaccggaaaaaagcggcagaacgcctttgcaagcttggggcaaagcatgtcatcataaaaggcggacatcagcctgaacaggggagaatcgttgatttattatttgacggttcgtcttttacccaaatcagccacgcttatattgacacgaaacacacccacggaacaggctgcacgttcgcagccgcgctgacggcggaaacggcaaaggggaaaaacattcagaccgcgtttgagacagccgtcaattttgtgcgggaagccgtggaacatacgctcggcatcggagcgggacacggcccgaccaatcattttgcctttaaaaggaacagtctgcagacgagataaaaaagaggccgcgtcaacatccgcggtctttttcccatgctttcaatctggacaaggttatgatatgataaaaattaagatcaggtactaaaactatgtctttaagacgattacaggaggctttatacatatgaatttctcacttgaaggccgcaacatcgttgtgatgggcgttgccaataaacgcagtatcgcatggggaatcgcccgttcgctgcatgaagccggagcgcgcctcattttcacttacgcgggagagcgcttggaaaaatcagttcatgaccttgcggctacattagaaagaaatgattccatcatccttccgtgtgatgtgacaaatgacgctgagatcgaaacttgctttgcaagcattaaagagcaggtcggcgtgattcacggcatcgcgcactgcatcgcgttcgcaaacaaagaagagcttgtcggcgaatatttaaatacgaaccgcgaaggattcctgcttgcgcataacatcagttcttactctctgacagcggtcgcaaaagcggcgcgtccgattatgactgaaggcggaagcatcgttacactcacttacctcggcggagagcgcgtcgtttcaaactataacgtaatgggtgtggcaaaagcgtctcttgatgcgagcgtgagatatttagccgctgacttaggaaaagaaaacatccgcgtcaacagcatttcagcagggccgatccgtacgctgtctgcaaaaggaatcagtgatttcaactctatcctgaaagaaattgaagagcgcgcgccgctgcgccgcacgacaacacctgaagaagtgggcgacacggctgcattcttgttcagtgacctgtcaagaggcatcacgggcgaaaatcttcacgtggattcaggattccatattaccgcacgttaaataacaagcagtccctttcagggattgcttttttctttcttctgattttaatcattccgtcatataaataaaacatgacagaatcggagggatgaagatgtcaaaacaaaacagaaacgcggaaaaaaaaccgctcatgtatattgttcaggcggattattcagacacgcaatcatcaatgcaggacatattaatcaaaaaaaggaaagcgccgcagccgccggaagaagagccgatgcatggaaagcgggaggaagaatgtaaaactcagcctgaaggagcagtggctgtcgaaccagaaaagcaagtacctgaacagcacagccgctcagaagaagccgttcaagaagttccggcgcaagcggagcaggacactgccaagcctgacgccgctaaaaaagagcctgatgccgctgaaaaagagcctgaagcggttcacaatgccgccccagaggaaaaggttccgccaaaacgcgtgaaaaagccgatgagcagaatgtccattcttgaaaaaattgatttcttaacgaagctgccgcataatatgccgcggaccctttgtctgatagaagccaacggaaaaacctacagaggcgtaatcgtcggcagaaaaaataatgcgatcttcctgcggacgacaagcaacggagcgccggcagaactcgcaatagacgatatcacctcgctgcatccgcttggattttaaccatacaaaaagctgcctgaattctttaatccggcagcttatttttatgctttttgatttaagaatgtgtgcggttgatcagtctcgggttcaggcaattgatggcgcagaagctattaagatcgacttcaacgcaatagttcgttttttctaaacggaatacatcgcagagagagtctttatctgtaaaatcaagaatgtgtttatgctcatcaaaagcaataagcaggcttaatgtggcacagccgtcacagaccctttcaactctgaaaaaaacggtattaaaacacggaccgttatccagctcgccgacgtttccgaatgcggtgaacggtttcgattttgaggtgaagatggcgaacggcactgtattgcctaatgtataagccggagataaaaggttagaataacagcctgtcgggcaatcttcttcgaccgcattttgcaggtcttcaatattttctaccgcttcacgcacacagtatgttgttttctggttcataatatccctcctgccttaacgttttaaatgggaccggattaaacgatatcggagagtcagccgcccggaagtccgggcgggctgatgattgcatctgtaatagaagattggaaggggattctctttagaaaagatgcgaatcaatgactatccgtgatgctttttctctttgtgcggctcaggccggttaacaagctccggtgaaaggcactgaatggcgctgaagcagctcagatcaacttcaatgcaaaattctgttttttctaaaccgaagaaatcaggatcacaaggatggcagacgctgagggtgtcgccgtgcacatctacggggcgcaatactgacagcgtcgcgcagcaatcgcatagtctttctacacgaaagaaaatggactcaaagcactggctgtcatccgcaaatcctccgacgttcccgaatgtggagaacaatccgccttttttatcaaatacgagaaacggaatggtgtctttacctgcaatcgtcgggctcaaaagattcgtatagcatccagtcgggcattgttcttcaacagcctcttgttctgctaaaatcttctcgactgcatcgcatacacaactttcatctcggccatggtgttttccgcagctcatggatttcagctccttcttttagggtatttgacttttgtctttaacaacatatgtacgcgagcctcacttggtgtgggtgaacgtctatatattcatcatatgcggagaaaataagaaaaagcagagcatttttagctctgctttttctttttagaggacgagggtgatgactaagacagcaatcagtaaatttgtggctgttgagatcaacactgcgatatcggcatctactgttgtcacgtttacgccgcgggagttttcgatgagcagtttttgacggttgatttgtttgttagctgttagctgcaataagtcttgtgcgaccaattcggcgatgactccgtcagcaattgaagtgagagtggccgttacgactgctgcattaatcgctgtcatgactgaagcgactgcttgaacgtctgttgacgtcacgttaatatcacaagagtctctgataataatcgcttcttcagaaacttgtttgttgagattcgcctgagccaggtcttggtcaaggaaggcattatcttcgccaaatccatgtccgttacagcaaacattacatcttcttccttctttttcttctttttcttctcgcggatgttcgcattcaggatcaagtgcaacccaagagtatggtctgctttccatatctattcctccttttcttttactattattaaatgagccggcctcttattttgactcaggcatctatcctgataaaaatcactattttttagttattgaccgggattttggcgtctttgccggagctgttcgattaattgttctctgcgggtttgcggatttgtctgctgttcttgcgctttttcctgctcttttttctgtttctggctttcaagaaaagcttctgtttttgcctgcatgtctttgactaatgcgatcagcatttctttttcttcatcaggtatttcccgcattttatcctttgtcacgccgtgttttttgaagacattgctgacaagcacctttaaaagcggatccacttctggtagattttcgagttctttttttaatttttcgttatctgccatttgttctcacctctatttaaatatttgaaaagaaaggttaaaggatgtctagttcagcaaaaagtatatttaataattgaaacaaaatttgtacaaaggccatgatatcgtctgctgtcagtgtgattttaatattgcggctgttcaggacttgaatgacggtcctcttttttatttggcaatcatccaggatcagcagttcggttgcgatttggtcggctgtgtcttcatctgcgatcgcgagctgtgtcgcgaggataatcgccgtagtaactgaggcttgtatagaaagagcggccgttatatgtgttgtatctattgtgacattttcgcaatcaatcacttcgatcgtctgctcgaattcgttggataattgttcgtatatttgcggttgcagtgtttcgactttttcttcaaacgacataaccttcactcctttctcattcatactctatataatgcaaatgaaacgccgagcggaataagaaaaacaactaaaccgcacctatttttttgccggacaaggtgcgattcatgaagatcagggttttcgcatatgtataaagaggtcatgttttgaaaaggagtgaacaggtggttatcaattggctttcatttattctgttatcgtttgccgttttccggctggccaggcttttcgtatttgacaccattatggcgccgcttcggagcctttttcacgaggaaaaaacagaaaccgcacccgacggcacgacagaaacctacattgtcataaaaggaaaaggcatcagggcatttatcggtgaacttctcagctgctattggtgtacgggcgtatggtgcgccgcctttttaattgcggcgcagattgtgatccccgaggccgcgcaatggctgattttgctgttagccatagccggcgcggccgggatcattgaagctgcggtttctcgtcttctgcaggaataaggcggttccaccagcaacttaccgtcactttcggcataaactggcatatatgacataaggaaaggaaggatcaccatgaatcaatcaagcaaaccttcccaacactctccatacaaatcaactgtgcatcagccttacgaaaaaaaaattaagaaaaaaggctgcggctgcggccaaaagaaaaaaccgaaatagccgtttttaaaaaaccggagcttccggtttttttgttttttgccgaacgccggcctctgtccggcatagatcataggaggaggggatgttatgaatatatttgaatcattcataaacggtaaataccgccggcacaatcaaaatcagcaggagcatgacaactatatcttatctattgaaaaacagctgtctgagtttgatgaagcgggatcgcgctttgaggaatggatagatgtgtttgccgccgaaacagaatcgaaactgaagaaaaatgagcattctcaataaaatgaatgaaatccgcaccggccctatgcatttatccaagccaaacaagtcggctcacatagagtatagagagtaaaggaggtgcttagatatgggattcggatatggcggattcggcggcggctacggttacggcggctgcggcggatacggaggcggctatgtcggaggcggctacggctcaacatttgttcttgttgtcgtattgttcatccttctgatcattgtcggtgcatccttttttggctaaaccttagcaagactttggataagcgcgggaccgttcagtcccgtgcttccctgatgtatgaaggagtatagagacggggcactctgaattttttccttgtcttacgggcacatgttccgctctttattcatacaatatcgtattactccacaaaaggaggcacaccatggataatcaatttttcaaaaatattgagaagaaaacaggcgtcagcatgaaggatgtcatgaaccttgcaggatcattgcaaaatgccaatttcaaagatgaaaacacggtgagaggcgtcattcagaaggtgtcccagctggctaacaagcgtgttccgaaagaattggaagacaaaatcgttcaatcgattacaagcggtaaagagaaacttgattttggcaccatttctaaaatgttgaacaataaataggcgtcagccggccttgctaaaaaggcctttttatgtgagaaaaacccggcagatcactgccgggttctttatatcctgagtgcgctccgtctgtccgtccggagaaggggctcgagaaatcttgagctgcgcgctgtttttccccgcctgtacgcgggacaagatacatataaatgctgcatggcccttgtcattgcgacatacaggagccgtctttcttcttcgagcggagcgggatcgccctgtctcgccgtctcaagcgcgaagtcatgggggatcgagccgtcagccgcgcctaaaatatagaccgtattgaattcaagacctttagagcggtgaatggtcagcagttcgacgccgttttcatcggttttctgattctcagcggcgcgcatatgatcgacatgcgcaagaaaatcgggaatggttttgaattttttggcggccactttgacatccctgagatcatcagagcctttttccagtttgtttccctcattgccccgtttttttaaatactcggaaaaacccattttgctttctgcaaaggtgatggcttcaaccggcttcattgtccggatgcttgcgaaaaacggaacgatctgcttgatcttccctatttgaaaaggcttcaggtcaggcagtttcgtcagtgccttaatcatcgtgcaatcttccgtgattgacagcgcctttaacgtttgcagggcggattgctttaaaaataaggcgggcagcaggtctttcaccgcatccgtatcatcttcattctgactcgcatataagtaggcgaggatctggcgtacgattctgcggctgtagaacgtctgcacgccacggtcggcatgataaggaatcgatgattggtgaagtctttcataaatggcccgtccggcgctgtttgtccggtaaagcacggcaaaatcgtcaggactcgccccgttttgaattttctctttcatatccgaaacgatcatggtcgcctcttcttcttcatcgtaaggataaaatatcacgggattgtgaacgccgtctttgacggcagaaagtattttttcataccgttttttatttttctttacgacggcatgagcgcttgagacgatcggatgcggcgagcggtaatttgccgttaagtaaatggtctttgctgccggataatccttttgaaaatcaagaatgaaagacgggctgctgccgcggaacgcataaatggattggtcgtcatcacccacgcagcacaggttattctccgggcttgcgatcatttgcataatgttgtactggacaggattaatatcttgaaactcatcaatcaaaatatgagaaaatctgttttggtactgcgcgagaatatcaggccggctttgaaacagttcataacagccttgggccatgtcatcaaaatcaaattgccgtttttcccgcttctgccgttcgtaacgttcgtagagccggtacacttttttctcccagtcgtccgcaagcggaatggtctcatgggggagatacgtgtttttccagcagccgataagctgtagcgcctggtcgacgggaaactctttttcatccaaattttcttcataaagcgcctttttcacatattgctctttttgccactccatttttaaaagctggctgccgttccattttgaagaatcataatgatagagtattttatagaaaaaactgtggaatgttccggtcacgagacgggagacttttccggctgccagcccgtactcattcgccatccgctctttcatttcggcgacggcttttgtcgtaaaggtcacaagcagcatattctcaggtgaaatgccgaggtgttcaatcatatgggcggcgcgggctgtcagcacccttgtttttccgcttcccgctccggcaagcactaataaaggcccgtccgtttcagtaactgccttcatctgttcgcggttcaggccgatgccggggaacaaagatgtatcagccgcctcggatgttggtgaaaacggttcggccgcaggcacttttttcgggcttttccattctgagacgatcggtttcggattctctgaaatcgcttttcctttcggcaggcggaacatgcctgcctccttatactcttctttttctttctccgcttgtggttcctcggccgcacatgctttttcacaggcggtgaagtctcccttttgccgatgataaaatgccggctgctctaaaatcgaaagccgcatcaagacgggctggtcacaatgtgcgcaaaaaatatttcctttctgagcttcttcaaaaaggaattggtaatgttctctagaatatgtatgtaaatgtatcgttcggttattcagtcgggcgcatttcaaaaaggggtcctcccattaaaaggtgttcatccatttgatagacaaagaatatcataacaaaagaaccgcgtttcaaaaagtaagattaagggaaataaaaagcgaaggggaggggtacatatgatttatgcaggacggattcaaaaccagcagtattctcaatacgcaaaccgggcagcgggttataagcctgattacgccggtattacgaaagcggccgccctcgccaatgacagggtgtacagagaggtggagcgccgccaggaaaacaccgcagccgcagcaaagaaagtgcatgaagaaaaacgtaagcgctctctttcccgtctgccgcaaattatgggaaaaggccggttgataaatcaatacgtgtgaaaaagcccggaaatctccgggtttttttgagccgtatagatgaaagatgcggaaaggaatgattcaatttgagaaagctttcattattaattgcggggttatttctattcggcctctttactgccggaatgaaaccggcacacgcggcggagagctccgcagcaaaagatgtcactcttacacagctggcgccgcatgtctggatgcatacaagcatcggtacggcagacggaagtcccgtccctgcgaacggattgcttcttgaaacttccaaaggaatcgtactgattgatactccgtggaatgacagtctcacagagcaattaatgacagaaataaaacagcggtttcccggcaaaaggatgaccgatgccattgtgacacacgcccatgacgatcgcatcggcgggctgaacacactgtacaaatacggtgtaaaggtgcacagcacgaagctgaccgccgacttcgcccggcagcagggatatcaccggccgctcggagatttgaaaaacgtgacaaagctgcagtttggcgatatgaaaattgaaacgttttatccgggaaaagggcatacggaagacaatattaccgtctggctgcctgaggataagctcttattcggcggttgtttaatcaaggctttagaaacaaaggaaatcgtgccaactccgggcttttatccggatcagtggccgcgcgccgtccgcaaagtcatgaaaagatatcaggacatcagcattgtcgttccgggccatggcagtccgggggatgaccgtctgctgccgcatacgataagccttctgaaagaaacgtaaaaaagaaaaccggcgctcccattacggagtgccggctttttttatctcttcctgattttcataaaactgaggaaagcaagtgcaagcgccaaaacggtatatcccgctatcggccaaatatgctgatgaaaggaagaataatctccggatatgacttcctgggccagctcgatcgagtgaacaaacggtaaggcataagcgatatgtttgaatgtgtcaccgagcaggctcacctccatccaagctccgcccagaaattgcacgagtgtaatataaatcgttccgatacctgaaatttgtttgtccgtaaacacagcccctaaacataaaccgaagaaaacggacatcatcgcaatcggcagcaagacagcgatacctgcgagaagattcatccactcggcggataaaccggcagcagcagctgcgataaaacaaatgatgatttgtaaaatggctaacggcagcatcggcattgcgtaaccgataacataatcggctgtttttaaaggggaagcaaacaaacgggtcaaaagggcggtctgtttgtcttttgcgatcagcaatgcagagaacatcgtaaggaaagcgaaaccgaaaacaatgagtccgggtgctaagtgctgaattttaaaggtatcaagtggcgcatttttttcaattgccgtaaacagaaacaatagaataacaggcagtgcgattccaaggataatagacagggggtcacgaaaaatctctttgcggttgcgaatggcgaaatcaagcataaagacccgcctctccgtcacaaatcgctaaaaaggcatcttcaaatgtggctgaatgagtttgttttttcagatcctccgccgtgcccagtgcttttagagtcccattttctaaaatgcaaatacggtctgccagggcttcagcctcttctaaatagtgtgttgttaaaataatcgtcatgtctccctttaatgtctcaagatttttccacaactcgcggcgtgaacggacgtccagccctaatgtcggctcatctaagaaataaatatccggttttgtaatcatgcccattgcgatgctgaggcggcgctgcattcctcctgataaggttttggtttttgctctttctttctcttttaattgaaacaattcgagcatctcatctgttcttttttttgcttcttttttcggaattccgtagactccggctataaactctaagttttcccgtacggttagatgaggagcgatggctgtttcctgcggggacatgttcaatttcggttttattttatccaaatcagtcaaaatactgtgttcaagcactgatgcatcaccctcatccggagagaggagtccgcaaagcatactgattaatgtcgtttttccggctccgttctcaccgagtaaagcgaaaaattcccctttctcaactgagaactcaagacggtcaacggcggcggtttctttataatgtttcgttaattgcttcagctcaatcgcgtgcatttactcgttctcgctatctgcgtcgatttgcttagcgtttaaaatatcttttgcaaactcgaaaaagagttcttgtttaacaagtgcgataccttgctggtcatccccaagcataagcagtgaatcccccggatttatatcgaaaacatctcttgcttctttaggaatgacaatctgtccttttgtgcccactttaacagtcccgaatatgtgttttccttttggtgccgtcatgtttatccctccgaaatatgaattatattttttgtatgaattgtaatacttcgtatactaaacatacattaaccttccataaaatgcaataaatttcatgaaatagtatgattttcataaaaaaagcactcctgccatatcaacaggagtgcttttgattttattgtttgtattcctttatcatttccagatgggggatgcccgcatcgagaaattcttcgccggaagtgacgcggtatccttgtttttcgtaaaacggaaccgcctgcgtctgcgcatgtaagataaagctgccggcgcccttggctgccgccgctttttcaagcgcctgcattatgatggctccgacgcctaaagaacgatggcttttcattacgcagatgcgctctaattttccatgcccgtctttcaagcgccatctgccggctccgaccggctggccgccgtcatatatgactatatgctctgacgtgtcttcgaattgatcaatttcctcttcttccggaacatgctgttctttcacaaagacctcttttctgacgaaaaaagcgtcgttcagctgtttttcagtttttgcgatgatggattccaagcagttattctcctccgcctaataaaaatgtttcgtacacagtccatgagccgttatccagctgatagagcaggtgaaaacggtcgatgacttcttcgtgggaaatgtcctgcattttcagctgtccgagtacgtcggaatgttcatctgacgacagcttctggccgaccgtgacatgcggaacgaagctgtattccggctcgccggataatgctcctgagtagcatttctcactcagagattttaattcctccgtcggctctgctttcatatatatcacattattcacaggagaaaacgagctgtattttgtgattttcagaacgagcggatgcgactctttcgccgtctgtctcagctgtgatacgacctgctcgatttcctgttctgtcgcttcaaacggatctcttaccgtcagatgcggcggaatgagcgcgtagctcgggtcgtagcgtttccggtacgaatttgcgagatcctgtaatttttttgatggaaataaaacaataccgtatttcatgaaagttccctccttaaatgaatggttacagcatttttttcagcgccggcgtgatgagcggctgccagtatgtccatttatgatccccgtcaaaggtttcatacgtgtattcagactgtttgctttccagcagctgtttgagctcttcgttcggcgcggtgaaatcaagcacctggccgtccgtcgtgtggacggcggtttctttttctccgatttgatgataaacggaaatctgtttgagatcctccgactgccggacggcatccagcacgtgcccgtcaacatacggagactgcatgatgacgtttccaaacatattcggatagtcaatcgccgtcatgagcgaaacggttccgccgagggaatccccgatcatggtgcggccgtatccgacttgataagtcgggtattctttgtcgataaatggaacgagctcattggcgataaaccgcttatatgaggcgaacttagagccttctggatggtatgtgtttcttcgctcccgcacatttttataagggacgccgataatgatgcagcggtcaatttccccttttgacataagctcttccgcctgacgcccgattctccctaatctgaaataatcatggccgtcctgagcgatgaccgtatgatatttatacagggggagaaggtggcgggcaggtagaccaaaacggtcatttcctcttcaagctcatgggagaaaagtgttttctcatgaatgattccgttttttgatgccacttcgcattcctccaggccgcttcttgtcttgatggttttttcctattgtaccatgaattattagaaatttctttcttcagatgcacttcttgcgagagttcagataaataaaaagttgttgaaatccattttatagtgcgttaatatagaacaatcagaaaatacaaaacaatattcttatcacgagaggtggagggactggccctttgaaacctcagcaaccggtttgctttgccgcgggaaggcaaagtgccaaggtgctaaatccagcaagcgattcacatgcttggaagataagaggaagagaaaagctccttcttcttatgaagagggggcttttttatttttgaaaaaggatggtgcttactgatgacgcagcatgttgaaacaaaattagcccaaattggaaatagaagcgaagaagcaacgggaacggtcagtccgccgatttatctgtccaccgcttaccgccatagaggaataggagaatctacaggttttgattacgtgcgcacgaaaaacccgacacgccagctcgtcgaagacgccatcgccgtgttggaaaacggtgcgagaggatttgctttcagctcgggaatggcagccattcaaaccattatggctttatttaaaagcggggatgaattgattgtatcctccgatttatacggaggcacgtaccgtttgtttgaaaacgaatggagaaaatacggcttaagctttatttatgatgatttcagcgatgaagactgtttacgctccaaaataacggaaaacacgaaagcggtatttgttgaaacgccgacaaacccgttaatgcaggaggcggacattgaaaaaatcgcccggattacgaaagaagccggcctgcttttaattgtggataatacgttttatactccggtgctccagcgcccgcttgaactgggagcggacatcgtcattcacagcgccacaaaatatttagcggggcacaatgacctccttgccggtctggctgtcgttaaggatgaagagctcggcgacatcatgtttaatcaccaaaatgcgatcggcgccgttctcccgccgtttgattcgtggcttttaatgagagggatgaaaacactcggactcagaatgcgccgtcatgaagaaaacgcccgtgaacttgcagaatttttagaacaggaagaggaaatcgccgacgtgttatatcccggaaaaggcgggatgctgtctttccggctgcaaaaagaggaatgggtcaatccgtttttaaaggcgctgaaaacgatctgtttcgcagaaagtctcggcggggtggaaagctttattacataccccgcgacacagacgcacatggacattccggaagatatccgtatcgcaaacggcgtctgcaaccgcctgctgcgtttttcagtgggcattgaacatgcagaagatttgaagcgggatgtaaagcaggcattacagcaagtaaaagagggggccgtgtcatatgagtaatcacaattggacgctggaaacccagctcgtgcacaatccatttaaaacagacggagccaccggagccgtcagcgtgccgatccagcatgcttccacattccatcagtcttcatttgaagaattcgggacatatgattacagccgctcaggcacaccgacaagaacagcgcttgaagaaacgattgcaggtcttgaaggcggaacgagaggttttgctttcagctccggtatggcggcgatttcgacggcatttctgctcttatcccaaggcgaccatgttctcgtcacggaggatgtgtacggcggaacattccgcatggtgactgaggttctgtcccgtttcggaatcgaacatacctttgtcgatatgacggacacagaagcggtcgcccgcgccatccgtccgaacacgaaagccatttatatggaaacaccgtcaaacccgacgctcggcatcacggatattaagggcgtcgtcaaactggcaaaggatcacggctgtctgacataccttgacaatacattcatgacgcctgctctgcagcgtccgcttgatctcggtgtagatatcgtgcttcacagtgcgacgaaatttttaagcggccacagtgacgtgctgtcaggccttgctgccgtaaaagatgaagagctcggcaatcagctgtataagctgcaaaactcgtttggagcggtgctcggcgttcaggattgctggctcgtattgagaggcttaaaaacattgcaggtcagactggaaaaagcgagccggacggctgagcggctggctgcctattttaacgggcatcccgccgtcaaaaacgtttactatcccggccttgccggacacccgggagccgatacccataaacgtcaagcgagcggagcgggcgccgtcctgtcctttgaattggaaagcaaagaagccgtcaaaaagctggtcgaaaacgtatcgcttccggtatttgccgtcagcctcggcgccgttgaatccattctctcataccctgcagccatgtcgcatgccgccatgccgaaagcagagagggagaaacgcggcatcacagacggccttctgcgcctgagcgtcggagtcgaaaacgccgaagatttagaacgggacttcgaacaggcattgaaaaaaataacccccgcccaagtgagatcataaacgaaaagggcgccgtcaattttgcgacgcgccctttttttattttagataaaaaaagtgttgacgaatgagaaatcaggatatataattataaatgtcagagagacaacaacatacccagcaacacatacatatcatgattccgtagctcagctgggagagcgctaccttgacagggtagaggtcgctggttcgagcccagtcggaatcatagccaaaacccttgcgcagcaagggttttttactttcttttaatatagccggtttatcaaattcgtaagttgttcgcaaactgttggcgaacttgattttttggctcgaaatttattggccgtatttctttttaggatcaaaatagttgaaaagttcagctggtgatgccgtcaagtagatccaaaccgcactgtgtggtattgcatttctatccggataaaaaagccaaaaaatcggtatcaatataaaaaggccctctcataaaatgggggccttcagtgtttcttttaaatagcttcttttagttgttctattacacttttcaaccattctataggtggtaagccaattgtcgggaaatatatttctgcattacactttataatgtcttccttttcttctttagttagatcgctatttagaaactcttcgcaatactttactgtaaataccaaaccttctttactaatttcctcaataaattcgtctaaggcgtgttcaggggattggatatcttgatgaaatgttgcacctaaaaaattttctaattcatctaagaaatcatacctttcatccatgatacttcctctctttctatttggttggatatcctgtaaggataaagttaccgttattatcttttttgagtataatttttgcgtttgtaacgttttctactagttctgaatttcttgatacacttctgcctattatttctccatcgcccttgtatcttaacattaatttaggttttttaggatcatcaatccaattttcgattttctttatattttttggatcgtttaaaactgaattagcaattctttcagcggtagccctatctttaaaagtagatgaagctgtaatatgtgggttaggatcagttttcagtctttctattaattctttatctgttttcccaacatgcctttctataaggtgtccgccttttgcctcgtgggcagctaatccgccgcccggtgcgagaggactgctgtctccttgtttaacactatgtatgccgttattgtcagaagtcacagatttactgagaacactttctttctgatcttcaataatacttttcaataaaggcgtattcttcacattgtgagtattttcaatatcctggcctattccggcaagtgcaggttcatacttatttttagaaacggaattgatataattttttcctttttcaatcccggtttttacatgttttgcagccgctttttcaccggcttccaagacgttatccactttggcggcacctgttttagcgagcttgcttgatacttttacagctgagccggaacctttgagcccgacaatgcttatttattgattttgtcatcattcatcgaggggcgaattggggacggaactgcttttttgggccgattttgaagtacattcgctgtatacttcaagggaggtgaacatcgcctttaaggcggcggtctttgccgaaacctgttcattacagagaaatacagaaattccgtatcactgaacggctaaagtgataacgatcagcagctggttaatcctgctgtttttttgtatttgaaaaacggaatatttagttttgtatgaaaaatacagcgaaattctggaaatcattcatagaacaggaaatgacgcatgcagccgctaatgaaatcagttatatgaccggtagcagcgaatcgactagatatcattttgccgtcgatgataaagaagtgatacagggggccctccatcctaaggcaagaaatcatccttccccttgctttccggttttttaaagtcaaaagcccattgagcgtaaaacagattcgaacggcgctgtcgaccctttattaaagcggaagaactttggggttgatggagcatatggagcgaagacagcgaatgcagtaattgatttcaattggtgaatggattaaaagctgatggaatttatgcgcttgaaccaaagcaaaacttgaagtgttgttaaaataagcggagactctttccttttttacagactctctcccacactgaacaagaaggggttgtgttaaagcaaaatctaagaaattaaatccaaaaagattgcaatgacaagcttctaaagagatgaaaaatatcgggatatcaactaaggcgcaaaatgcaataaaacaggagcttgaaaaaagaaaagaaagagaaaaaataaaggaacaagaatatttaatcagaaaacaaaaagcaaaagaaaagcataggggcaaatagttggagaacccgctgaagcacttcgattgaaaagttgagcggcatcagttttttgcttcggactgatttagagaaaaagaagtataagtcagagcccttctcaagatgaggagggtttttttgcaatttatttaaattcacttacatcagtaaatgcggctgaacgattcagtacgattcagctcatgtatggtttgaagccagacggaatttgcggaccaaaaacgaaagcgaaatttaattaataaaagaagcccttcttaaaagagggctctttttctaactatgttgtttaagatgctttttaatttgttcagtgacttgcttaagccattctaatggagttatatcatcttcaggaaagtatataccatccgctgcttcctctataaattcattcttgtcttcttctgaatgatcactatttacaaactcagttagtgctattaaatctctttcttttagtttttgtgatgcttcatttaaatattcatcaagtgcattttccggagactctatatcttggtgaaaatgtccaccgagaaatctaaatacaggatcagaaactttaatttcaatcattatatatcacctcgttgggtagcctgttagtataaagctaccatctttatttttctttaatactattctagcataagtcatatctttaacttcatttgaacctttacgaactcctctacctataacttcggttcctctataaggtaacggtaatggatcgttaacatcactttttaaccactcttcaatttcctttttatgtttagttaatgtttcattagcgactctttctgcagttggcctatcagtgaaactagaagaggcacgtatcttcttgtttatctgtagcctctgtaataactcttcatcagtcttaccaacatgcctttctataaggtgtccgccttttgcttcgtgagcagctaaacccccgcccggtgcgagaggactgctgtctccttgtttaacactatgtatgccgttattgtcagaagtcacagatttactgagaacactttctttctgatcttcaataatacttttcaataaaggcgtattcttcacattgtgagtattttcaatatcctggcctattccggcaagtgcaggttcatacttatttttagaaacggaattgatataattttttcctttttcaatcctggtttttacatgttttgcagccgctttttccccggcttccaagacgttatccactttggcggcacctgttttggcgagcttgcttgatacttttacagctgagccggaaccttttagtccgacgatgctcccgatggcgtaagtgatgtaatgggatcttgaatacgcatccccgttaaccattttatcattccatgaatccgccaggtttgtccatatgatttttgcgtaggagggcgtgttcaatacagcagatatggttttagcgactttttgttcatcagagagatggtaaaaatcccatgcgccgacagcgagatctttgacgcctattatggtgtcttttcccacatcataaaggccgacgcctattcctttgacgatatcccaagctgtttctccgacttcttcgagctgttttgcttgttcgagctgcatcacatattgcacctgagcgggttcaaggttttcatagccgatcttcttcgcgatttccaaatactcatccggatcggttacaccatcagccagctttttcttcagatccttgatttcacgctctttcgcctcttcctttttaatcgtcaaataagcatccgaatgtcttgcgatgtcgccttttttcttatggatatcgctttctcggtatgctttggcattgtagtgaagcggcgtggcgccttttcctttgcctgtggcgttttggagctgctgaaagtcggcttggatgaactgttcgtttgcttcggtttctgcgtattctttcgttagatcgtgatcaagtttgccgagcttatgtattgtttcgtttctttttttgtcagctgaagagagcttctgatccgtgttttcggttgaaaacagatcaagcgagatgatgtcatcgatctctccgaggatggagcgcatgtcctttttctgctcttccataatcgcctttgatttactgagggcgtgggtgagctcgtgttccagaaatgattcttctacatgtgaattggaaagtccggcatcttcgaccttgccgggaaggcttgtgagaaatgcgattttcatatcgatcagatcaagccaactgtctatgacgccggcgtggtccttgaaaaaagctttaatgttgtctgcgccccggccggagaaatcattgtcaccaagatcagccatgccttgaaaggcttttttcaggttgaccatctgaccgcgcagttttttgtattcacccgcgcgctgtttggcagcggccaggagggtgtttgcttcaaaaactttcatgaccatatcctttcatgcgaaatacttcaacaagatattaccatggaagaatgaaggaaaagccaaataagtattttgaaagtgcaaaatgattaatttgttctgggtaaatttacttattttaagatcgggaattggagtagagttagctttgggttgaatcggttgttagaacatcatgtgacgcacctcctttgaaaagcatacacacatattagagggctgaaattcacccgaatgaattaggatacgacggtcaaaccgcttttcgcatggaactaacatgggcaactggtcaacagctttaaaaacttcatcataacagggaaatgcggcgggcattgggaatataaaggaatataggcttacagctatgaaaaatgtatgaaaatccgtcagacggcgaaggaaaggcaatctccatgtgttgtgacagttcgaatgcgggtgtatggaacttcccattcatccgagttatgtcagagggacgaaaagactttttttgaggaggaagcggaatgattgaatttacacggccattgcctatgaagaaaacatgcacgatgcacccgggaaaggaatctgtcagatcggtttcgtttactgattttaacggcaattctgtaacagtaaccctttgtcaaatgtgtctggctgaattaaaaatgaaagccgcgactgaatacaggagcatgacagaggagcgggccaaactgaatcgtttcaagattggtgatcatgtgtatttagagcatttgggagtcgtcagcgagataaaaaacatggaaggcgttcaagtggcaaacaggacagacacagacggagtccgaaaggctacccctaaggaaatcgcagaatacaaaaaacaggggaagcaatgacggtgaaaaaacgattcagtcaattatttatcaattgtgttacttatgagagcggcggccgttgcgccgcctgcctccgccgcatggtccagctggcaaaatgaattcgggtggagcggcggggcggctccggcaagaaatcaaacgctgtatcacatgggttcttctcgaaatatctgccggaaattaaaatttcagctgctttcctaactgtcacggaaaacatctcacaggaaatatattgactttcatcctgtttgtaatgttaattagaagatgtatacaaaaacattataatgaggaggcctgagtgtgaaaaataaagcgagaatacaagttggactatgcattggacttttatgtttaagctttaccggtttcagccctttattcggctctacgcacgctgaagcaaaatccatagaagacacaaaaatgacaagctgtacaacgaacaaaaaatttgttcagcttgagaaaaaatttgatgtcaggcttggggtttatgcgattgatacaggttcaaacaagacaatcgcctatcggccgaatgaacggtttgcttacgcatcaacctataaagttttggctgcagctgctgttctgaagaaaagctcaaatgaaaaacttaatgccatcatccgctacagtaaagacgatttagttacatattctccaatcacagaaaaacacctggatacaggcatgagcctgaaagaaatctccgaagccgctgtccgttacagcgataatactgccgggaacctattgctgcagcagcttggcggccctaaaggtttcgaaaaatcactgaaacagatcggggatcatgtaacgaaagcggatcgattcgagacggatctaaactctgcgattcccggggatcgtcgtgacacaagcacagcaaaggcactggcaactgatcttaaagcgttcactttaggtaacactctcacgactgacaagcgcacgatcttaacggattggatgcggggcaacgctaccggcgacgaactgattcgggcaggcgctcctgcaggatgggaagtcggcgataaatccggagccggaagttacgggacgcgaaacgacattgcgattgtgtggccgcctgacagagctccaatcgttttggcaatcctgtcaaaccgatttacggaagatgccgattatcataatgctcttatcgctgaggctgcaaaagtcgctcttaatgatcttaaataaacattgccgttcattttttatggacggttttttatatgttgagaatgcggtatgccggtttcgatgttataatgtaaagccataaaatgatgggaagagggggagtttcgatgcattacataacggcatgcttaaaaatcatcagtgataaagaccttaatgaaataatgaaggaattcaaaaaacttgaggaagaaacgaacaaagaagaaggctgtattcagttccatgctcatccgcttgaaccatcagaacgcaaaattatgctttgggagatttgggaaaacgaagaagctgttaaagtccattttacgaaaaaacacacaaaagacgttcaaaaacaagaattaacggaagtagaatggttaatgaaaagcaatgtgagtgagtaaaaggctttgtctgttgttggccgactctgccggtaacaatcatcagtttcattcattaaaacccttgctgcgcaagggttttttactttgaaaagttctttatatcgcagtctttttatgggtaaggaacagacttggaatgaagatggccgcaaggatgatgacggatactaagaatccggcatggtagccttttaaactgttcggaatcgttggctgcaatccttgtatgacagttgcggtaacggttgcgatcacagctgacccaaagctggaaccgaggttttcaatcatatgaataccgacacctgcttccggaagccgtttgctgtcaagacctgtataagcttcactcattaatgggagcataattcctccaaaactggtgccgcggataaataatacgacggaaatccaaatcatacttgtgttatcggtgataaaaataagcgggatagatccgatcagcgaaagaacaagactgaccgtaaccacgtatttcgcaccgatcttatcaatcatttttccgatcagcggacgagtcacgagcattccgactccttgagggattaaagcgagtgctgctccgactgccgtgaactgacgaatgttttgaaaaaacagcggaaggattaacatcggccccatgatggcaatattcgctaagaacaacccaattgaagaagctaagaagctcttgtttgcaaacaaattcataggcagcacggtttggtttttcttgatcagattatatacaagataaatgactgctgaaacaagaccgatgcccgcccataaaatggtgtcgctattgttaaatgatgcatgatccgccgctttcgtaataccgtacatcaatgccgcgctcattaatgacaaattgataatcccgaaaatatcgagtttacgatctttgttgaatggttcaaagtctggaatggttttcatcataagcggtgcggcaatcaaagtgatgaacacgttgatgtaaaaaatccaatgccatgaagcgccttggacgatgaagcctccgatgacaggtcctaagatcgggccgaagatcataggggtgctgacaattgccatcacttttcccaggttttccggacctgccgttttaaccaagagtgatgacataagcggagtgataatgccggcgctgaatccttgaagcaaacggaagaagatgaagctggaaacgtcacggctcattcccgcaaaaacagaaatgacaccaaaggcgatgactgagccgatgaagattttcttaccgttatatttattcataagccagccggatacgggtactgcaatcgcaagtgctaacatatagcctgtaacggaccactgaatggtatccaatgttgtgttgaagtctttggtcagtttggcgatggcgatgtttaccatcgtagagtcaagcattggagcaattgctcccagtgcaatagcccaggcggctgtgagaacttcttttggcagccgaagttcctttcttttatgtgttgacatattattctcctctcaaaattgctgtatttgtttccttgtcaacaaaataatagagtgattttgtttctttgtcaacaataagagggatataaaaaggcagcccgttttcatggagcggggctgcctatggttttattcatatttattccgatttcatgtctgcaccaagtttctttatttctgaatccaaatgcctgctgtatgtttccacgaagctcagcattgtgtcaaattgttcatcggttacttgttcaaacacgattttgtcccgttcttgaaactctttatgcaattcctcgtgaattttataaatgacttttccttgctcggtaagcctgaaatagatttctttcttgttaagcggcttctgatagctttcgataaggcctttattgataagcttcttcgttaatttacttatagcgcctcttgtcatataaagggactccgcaagttttgtcacattggcgtcttcaattttttcgatgaattcgatgcaatgcacttcagaaggtttatgccccttaaggctttcttccatcttcagcctattcagccacaccatcttgttaaaaaagtccctgaaatccgtgaggagctgttcttttttgtccatggcccgtcctcctgctcggtggtgcttacacaatattataaaatgtttgtttctttttcaacaatcgtaaagttattatttaggaactgagagatagtgcgcagaaataagaaggagggggaacagaagaagtatcctatttttaaccgaaatgtggtttttcgagtatgtttctttccgtattcgttactagctcttcataacaggctaactctgcagccttacaaaaaagcaggctgcgaaaagagcctgctttagaattgcatcaatcattttcctgttgcggcatcataaaaagcgtcaattgcggttgtgtatttcaagacgtttttagacactttggcggttgcgcctaatggatacgcgtctgacagaacgctggagtgagcttcgggttcccagtaaaatacgccagttcctttgccgttcggaacggctttcaccagttttatggtgtcttttatggtccagtaggaatctttcggattattttcatctccgcccagttcaaccaccatgacttccttgttgtagcgtgaggcgatatcattcaaattagatgataaatggccggtgagctcccagtacggcttaccttcccaatagggatagaacgaaacgccgatgatgtcggtttttcctccgtttttaaagaattgatcaaaccaccatctgaataggctgttgtccgtgccgtgtgccaaatggctgatgaccttggtggccgggctgacggatttcacggcgtcatagcctttgttcagtaagccggtcaatttgctgaaatcgctcgtgctgccgtcgggcagtaaaattcctgaattcatttcatttcctacttgcacccaatcaggggagatgccgtgatttttaagttctttcatgacatcgtacgtatggttatacacggctgcctgcagctggctgtttgaatagccggtccattggttcggcttgatctggtggccgggatcagcgaacacgtcactgtaatggaagtcaaccattactttcattcctaacgcttttgcccttttggccgccgcaagtacgcccgctttgtcactatagccgagcatggtccatgttgtgccgtctttcagccaataatagctgcttggcggattcacaaacactctcagtctcacggcatttattccgtgatctttaagaatctgcaaggcatctttctgtttcccgccgtcatccagccagcgcacaccttcatcctccatttgtttcagccatcctatatcagcgccataggcaaacggggcatccgcttttgctttaggagacttctcaagaaatgtaaaagcggtgaaaatgagagaaagacagattgcgtttacaaatacacgtttcaatcggtttttgaacatcacaatacctcctgataaaaaagattgttgattgatttcactctgaatgtttcagctgtcattctccaataacgtcgtgaaacgctgaaacgcctgaattccttcgggtgtcattttaaaaacgcctgcatcggtcagcgcgcgtaaaaatacattcgcggtttctttttgtaaaacagcggctgcattttccggtgtcacgtctttatccgctttgatgttttcagcccacggaagatgaatgtctttgatgtcatgaggttcattcagtaaatactttttcacttctgccagctcatctttcaggcggggaggtaaaacggcgagccccatcacttcaatcagaccgatattttcttttttgatgtgatggacatcctgatgcgggtgaaaaatgccatccggataatcttcggaggtgcggttgtttctgagagcgagatcgatttcaaaatccgttcccctgcgtctggcaatcggggtgacggtattatggggttcatttgtcttcgcgatgatgctgacggtttcgtctgaatattcccgccacttttcaaaaacatacgcagcggcatctgtcagcaaatccggatcttttgcgcgaaggcggatcactgataccggccactttacggcttcggcctgaacgtctggaaaatgacgcatatgaaaagggtagagggaacccgcttttgccatcggaaactcatgggcgccgccttgataatgatcgtgagaaagaatggaacctcctacgatcggcaagtctgcgtttgatcccgcgaaataatgcgggaagatttccgtaatggccagaagccttctgaagctgtcgcggctgatgttcatcggcttgtgcacgcttgaaagaaaaatggcatgctcgctgtaatacgcataaggagagtattgaaacccccactgttctcccgctaagtcaagcctgatgatgcggtggtttgaacgggcggggtgatgcggtgttccggcatacccctcgttttccatacagagcaggcatgtcggataccggttttccggactgttttttaccgcggcgatgtctttagggtctttttccggttttgatagattaatggtgatgtccaattctccaaaaggtgttggtgagcggtacacgatattttttcgaatggcccgcgtcttaatatagtcgttgttttggctcagtcggtaaaaataatctgttgcttttttcgggcaatctgataacaattcgctgaaggcggcattgatcagagaaggggccggtgtgatcacgtccatgatcctgcttcccagcatgtctctttcagccggcgtatcgtttatgattgaccgttttaccgcgtctttcaccatttcgtccacatagtgaagcctgttttgtttcttgatatgtttcggttctgcataatccgtcagtccgagcagatcgagaagtctgtttcttgtgtaaatcacatctgtttcatttatgtcgcctaagacagtgctttctttcagaaaccctgccactgattcaaaaacgtcaatgaccgccgcctccatttcatttgtccttgtatccgttaggatgatgccgatgccaattccatgctgacgcaatgatttccgatatgtccgtttgtttcggattccagccgagaatgttccgcgctttatcgctggaagcgatgagggcgcttggatcaccgggtcttcttgcggccgctcttacttttatgtctctttcggtcacttgccgggccgcttccgccatttctgatacggaaaacccgctgcttgatcctaaattgaaaatgccgctgtctccgccgttttgcaaatattccagagcgagaatatgggcatcgattaaatcggaaacatgaacataatcgcgaatgcacgtgccgtcttttgtatcatagtcagtgccgaatatcaaaacctcctcgcgctgaccgagcgcggtttgtaaaaggatagggataaggtgggtttccggatgatgatcttctccgatggaaccgtccgttttcgcgccggcaacgttaaaataccgaagcgagacatattttatgccgcaggcggtttcacaccacttcagcattttttctgccatgagttttgattccccgtatgcgctttccggcttttccggcatgtcttctgtgatgggcgctttttcaggttcgccgtaaacagcggcggatgaagaaaacacaatgtgtttcaccccgaattcctgcatgacctccagcgtaatttgcgtaccgtacacattattattgaaatatgaaagagggtctttcattgattcgccgacaagggattgagcggcaaaatgaagaacgcctgttacgttctccttcgcaaacacagagcgaagaaacggtttgtcacggatatctccatggtaaaaaacggctttttcatgaacggctttccggtggcctgtctggagattatccacagctatcgtttcaaatcctttgtttactaattgatcaaccgcatgagaaccgatatagccggctccgccgagaacgagaatcgccatgatttatttttccctccattcagccgcgccatcgcttatatccgcgatgtagaaagaagcttcaagacctgtcctgctgcggtagtgagatgaaacggcctggataaagccggcggtttcttcactttccacaatggctatggcgcagccgccgaaccccgcgcccgtcatccgcgctccgagtgctccttctttccaggctgcttcagccagcgcgtctaattcgtcaccggtcacttcataatcatcgcgtaacgaacggtgggacgcattcatcagctccccgaacgttttcaaatcattcgatttgagagcttccgcggctgagagggtccgctcgttttcattgaccgcgtgccgggctcttttacgcaaagtttcacgggagagaaggggttcgagtttgttgaattcttctcccgtcaattccgcaagtgatgcgatattccgatattgccgcagttccgtgagagccgcgtcgcattcgctgcggcgttcattatactttgaagccgccagctcccggcgcttgttcgtattcataatgacgattttatatccgttaaaagcagccggaatcatttcgtgctcaagcttatcgcagtttaatagaatggccatgttctttttgcctttttgcactgcgaattgatccataatccctgaattcacgccgataaattcattttcgactctttttccgataagcgccagttcagtatcggaaacatccaggctgaataactttcttaaaatggaaccggtcaacatttcaatggaagcagaggagcttaaaccggctccgtttggaatcgtaccgtgaaaaagaatatccattccgctgtctatttggccgccggcttcaagaagataatggatcatccccttcggataattggcccagccgtcttcttttttgtatgctgtggcggaaagatcaaggcagacaatgccgctgtcaggaaagttttctgagtataaccggatctggtgatcttcgcgttttgcgcatacggcatatgttccgatcgtgatcgcgcagggaagaacgtgaccgcctatataatccgtatgttccccgatcaggttgatccggccgggtgcgaaaaacagttctccgttacttctcttgaaaatgtcttcgaatctcgatttcaaaagtttggcatccatgataaacctccgattctattttggggtatgctccagtatgaactgaatggctttttgtgaatttctggtgaggctgatatattccgctcctttcgttgcgatgagtttcacatgcaggcggtccgcatcttctttaatgtcatcataataagagccgacttgcggagccaaaatgatcatatcgaagtctttcatgatgtcgtaatgggatccgtaggcgcctgctgaggcggtgatcggcacgttgtattcttcggctccttctgtcagtgcgttcgcaagcatggcgctcgttcccgctccggcgcacagcactaacacattggtgccgtgttccaaggcggatgaggattcctgaagatttgtgctgatgacggaagccgcgtcttctgaggcgccggccatggcgggctgtaatgtttgcagcgcggtttcaggctcggtgtgttgggcttcttccgccgctaatactttgtcataagctttacagaatggcaggtatatcaggaaatcgacaatgattaatacagccgtcagaacaaaagccgagagccccatgccggttccgagaatcaagccggcgggcgccggggtggcccacggaagaacatacataaaactgttcattccgatgacatccacgaaaaatttaaacagacagacattcaccatcggcgttacaacaaacggaatgaaaaaataaggatttaaaatgatcggcgcagcaaagagaagaggttcgtttactgcgaaagacaccggaactgcggatgcttttccgactgctttcaattgcttggatttcgcgaaaagaagaaagataaacggaacaacaagggttgcgccggtccctcccattgtgcccacgaagttcccgagtccgacggtcagcacgttggacgcctgctcaccggcattatgaagctgaaggttcgcctccacatttgcgtaaataatagctgcgatggccggctctacaatagaaggcccgtgaacgccgacaaaccagaacagcgccatcattccccaaatgacacaaatcccgagataaccgtctgcggcggtaaaaaacggcgataagagagaggagagagcctccgcaaacgatacattaagcgtattcctgatcaataaatcaacgctcaccatggccaaaacggaaaaagcgaacggaaaaacatctttaaatgtttgtgaaatggtacccggcacttctttaggcattttaatcgtaatatttttcagcacgcagaatctgtaaacgttcaccgttatgaaagcggatacaaaagcggctaaaagaccttttgtgccgagatattccgtggagaatccgccgtcgatttgagtgacgcttaaaatgagaaacccgacgactgaagcaagcatcgctgaaacggggttgatccctttgtttttcggcatttttcggtttattgattcactcaggcacttcgcacttgttgccgcaacgatcaggccgagggtgcccattgaatagttataaactttccaaagccattcagaaacacttttaggccaagtgaaacccaacacttccggcacagcggcggtgaggatgaaaatgctggcgaataaaataaccggcatggcagttaagaagccgtcgcggatcgcacctaaataaatgtttcttgagattttttcaaaaaacggttttcccttttcgaattgcttgatgataccgttcatttttccactccttatcggcggcttcggtagagttctataaaatcctgaataagatcacggagcaaaagggttgtcatcaagtggtcctgaccgtgaacgaaaataaaccctaaatccatgtccttgccgtcagcttcttcagctaacattttcgtttgcgcattgtgggcgagggttaaattttcatcggcgcttttcaatgctgcttccgtgttttcgaagtttccgccacggacttctttcaggactttcaataaagtgcttctggcgtcgccggcataggcgacgatttcaaaaccgagcatctgcaattcttcctttgtcatgaaaaaacctcctaaagacggcacacatgatgaaaagagactcttttcaccatgtatgatcgttaaatgattgtttttgtttcacttacaagtttgtaccagtaggccgattctttcggataccgtttttgggtgtcgaagtcgacgtaaaaaagaccgtaacgtttgttgtagccgttggtccatgaaaataaatccattaaggaccataagaagtacccctttacattgactccgtcggtaatcgctttactgacggcttctaaatatacttttaagtagtcgatccttgccttatccataatgatgccgtcttcaaactcatctttatagcccatgccgttttcggtaatgtaaattttgttatattgcggatagtcccgtttgatgcgcatcagcatgtcatacatgccttcagggtaaatgagccagtcccaatcggtccgcttcaggccttctttgtaaattcgttcgccgattccttttactttatagaccgaagtgcccttatcgcccgttccgttatggtgaataacggtttctccgtcgtacgctttgacgaaatggcattgataatgattgatgccgagataatcattgcgcgtcgaggcttttttcatcacgtcaaagtcactgtctgaaaactcgtatgaagcgccgtttgcctcacagatttcatccagagcacgcatggtttcctcagaataatagccgaggtaggtggcatcgaggaggaatctcactgataacgcgtcatccagaaaacaggcgtggcggtcttcttctgtgccgctggcgggatattttgtttccaatgaatggacgaccccgatttctcccggataaccgccgtctttaaaaagattgacggtcatcgcatgcgctaccatcatgtgatggaggcattgaatgacttttgtgatatcacttttaatagatggcgggaaaaccccgagtaaatactggttggtggctgtgggataaatttcgttaaacgtgctccaatatctgatttcgctgaattctttaaagcaaaactccgcatagctgacgaacgcttctattgcagcgcggttgaggaaatctccctgatcaaataatcctttcggtgtatcgaaatgatgcagcgtgacaaaaggggtgacgttgcgtttatggcactctgagaaaatacgatgatagtagtcaacaccttcctgattgattttgcccgtgccgtcagggaaaattctcgtccaggctatagaaaggcggatgccgtttattccgaatttttcacatagtttaatatcttccggaaactggcggtaaaaatcacttgccggatcagggctgaatcttccctgtttttcaagaaattcatcccaggccacaggccctttgccgccttcttttgtggcgccttccgcttgatatgccgcagtcgctccgccgaaaataaagtcatgaggtaatttgagcattactgaatcctccttcgccaatgtgtgaattgtagtttattaatgtttgtaattgttatcttttgtttaatagtaaacgcatacatttttgttgtcaatagcttcataaagaaataacatctgtatttataggggttatgtaagtttgtcgttgttttttatgttgattgtgttgtttattagtgtttgtttttgttgaccggattgccgcagtatgttagattgtgtgtaaagttgaggggatgattgaacatgttaaaaaaagagcggcttttaaaaatcatcgatattgtaaactcgcgggggtttattacggtgagtgatattatcgatgaactggaagtttctgatatgacagtgagaagagatctggacgagctggataaggccggaaaaatcgtacgtattcacggaggcgcacagagcatatcttattccattgatcacgaattatcgcataatgaaaaactgggtgttcaaatggaggagaaggggaagatcgcggaactcgcagcttcctatgtaaatgacggcgataccgtttttttagggcccggcacgacgattgaacttttagcgaaacacctgctgcataagcgaatcaggattatcacaaacaactatcccgtatttgatattttgaaacatggcgacactgcggataccatcctgattggcggcgacttccgaaaaaataccggtgccttcgtcggccccatcgtgaacggcaatctgcagaaattcaattttacgaaggctttcatcagcgccaacggcatacataatgatgagatttcttcttacagcattgaagaaggggaagctcaccaaatcgcgctgaataattcgcggacgaaatttttgctggcggataataaaaaattcaaccgggaagatttttacgtgttctataacttgcacgatatggactatctgattacggatgataaagtcatgaaagatgttcaaattcattacgagcaatatgtagatgtcaaaatcgcaaaaaaataaaaaaggcgggcggttcgatgaaaggggttatttttgatttcaacggcacgatgtttcaagattcgcatctgcacgaaaaagcatggtttttcatggtgaaaaaatacgcaccgaaaaccatttctgatgaagacattttcgttaacattcacgggagaacaaacagtgaaatcctgacgtattttatttccggcgatttaacaaatgaagaaatcaagaagctgtcttttgaaaaagaagcctactacagagaattatgccttgaaaacaaagacgagttaaagctgacgaagggactgaccggcgtattgaaccatctgaaaaaatcggaaacaccgatgaccatcgccacggctacggtaaaggaaaatgtcgagttttactttgacgtctttcatttggatcagtggtttgattttgacaaagtcacgtttgatgacgggagcttccccggaaaaccggcgccggatatttttctcatcgcatcggaaaaattaggcctcaaacctgaagaatgcttagtcattgaagatgccttttcagggctcacagcggcaaaaaaagcaggtgcgggcaagattatggccattgacccgctcggaaaaaaccgcgcgctatttgaagaaaaacagctggcgggtgacgggatactgacagatttcacctcgttttttgaggtgattgccggacattctgtttgagagatcagccggttttcatgcgggtatggctgtacaggctgcagactccgttcgcaacacgggatgtttttgtgtttggcgcttctcgtgaagaaaggagtttcgctttttattcggagtcacttttaagacagggatatccctgtctttttaattcctcgtatttcttccaaagaagcgccaaggtgcctattgctgactgtttatatgtttcacgataaaatcctgagcatacaagaaaaccagccatcctgtaagtccaagccctgatgcggcaatgaaagacagtgaatggcgaagggcgatgccgataatgaccagcataatgactgtagaggggatgccggaagccacgctgaatgcaaaatgacttaatgtctccttcgtttcgccttggatgtacagccaaatcatgctcagcatactgacaattggtaaagccgctataatacctccataactcgggcttcttcttgatatttcagtgataaccccaataatagcagcggagacaatgattttaacgatcgtaaacatcttcagcacgctccttcatcaaacagaatgcttttaagacaagtgttcgttcttcattattcatgttgtcaaaaagaagctgtttaagcttttcttcatcaagaccggaatgccggtaaaggacatccgcccccaaactggtaagttttaaaatgactttcctctcatcttcaacacttctggttttataaacatactttttcttcagtaaccgctttatatgttccgaagcggtattatgcgatacttgaatcgctccggcaatgtcttttattccgactgccttctctttttgaatgacttgcagaatccgtacaccttggtgagtgattttttcatggtgctgataacggagccgatagtaaatatctgtccagaggtcatttaatcgtataatttcgttagacatcataagccaccttttatcgtttattaagattatatcttatattacgatatattttcgcggattgaaagcaatttttgagcatgagggagcggcattcgttctgtttttagaagattggaagagacaagcggccgcagcttcaacgaataaacttatttaatatactctcaataagtcattttccttattttaagaaacggcagcttaataccttccgcatataaataagagcactgacaatatgataaagaaccaaagtatatattcaaatgcagtttttttcagcagggcagtcctgtgctgattgaaaaagatacgggggataaaaagcgggtaagaagataaggaaaggagagagacggatggaacttgattttgtgattcgtctggcggttgcgggtctgcttggggctcttattggattggagagagaattcagggcgaaggaagccggtttgaggacgcattttttagtggccgtcggcagcgccttgatgatgatcgtttccaaatacggcttttttgatttgttatccaacagccatacgtcctttgatccgagccgggtggcggcgcaggtcgtcagcggtgtcggatttttaggagccggcacgattattttgcagcggcatgtcgtgcgggggcttacgacggcagcggggatttgggctacgtcggggatcgggctaacgatcggggcaggtatgtatgtcatcggcatcagcggcacgattttggcgttaatcgggcttgaactgttaaattttctgtttaaaccggcggcgcattctttgtctgtcagtttcaggattgaagagaaagccgtcatgcatgatattttaacttctcttgaggaaaaaggaattctgattacgtcctatgaattgaataaggcggtgcttgaagtgaagggaagggtgaaaagcaaaagcgggaaagcagcggtaatggagaaagttcaagccctcccgtatatcctgtcggtcaaagttgaatagcagacaggggaagcctcctgtctgcagtcatttcttttcaaacattaataccaaggatagaacgggatatacggccgcggatagtatgggtatggtctggggtaataataaggcggccgcggatagtatggatatggtctggggtaataataaggcggccgcggataatgatatggcacccgttcgtggctctcggctgtgtattcatgatcgaaaggatcgtacaagaggaaaacctccttttcaaatgttggttccgtttaccttattcctgtatgcccggtacggtgtatgtacaatgggcaaaaaaaagacgccggttatcatccggcatctttttttacactttcacatcaattgaatggccggcagtcgggtgctgggacggcagcattttcactgtttcttccgccgcagcctgtgcatgctgcatgaccgtttttgttaaagcgatatttacattctgcgccagagatgcctgatgcattgcgattgataacgcagggatatccatagcttccacctccttatcccttcatatcggcggcgtgctccgattatgaagagggctggcggtttctttttacggcccattctaaaagtgcggcagcgcaaaccccgagggtataggcgaaaatgtcactccagacaaattgccagccgaggatcagcccgccgagcgtgctgcttctgatcgcgtcaatccacggcgcgtgatacagctggctgcattcaatcagaaagcaaaacgagaggctcaaaattgcggctgtttccgtccggatgtgccgaaacaaaagcccgaatcctgtaaaaatcatggccgcccacagggcatctcctaaataagcgtttataatgccgggcaatagggcggtgatgtatgcggttctggacagcaaaccgagggcgatgataaaaacggtacatattccgtatgtcaatggatgtctattcacttcacactgttcccctttttttgtactcccatgtattgtaaggaacaacggagaagctgtctatgaaaaaaaacggcccgggaggccgctttttttgcgttatctggcttttaggttgacatgatctgctttttgatcactgccgatgacgaagcggagctcatactgccccgtatggtagacgtaatctgtttcacccgtttttggcactgtcaggattttgtcagcgctgccgatttgtttgcttaagacgtcaggtgtgacgctgccgaggtttaagcgccgctcgacccccgttccaaaatagcgtatttccgagatttttccgtttttatgataggaaaatccataaccggggtttcccatgttccagctgtataaatcaaatggattgcggctgtctgctttttgttccggctcgccgattttattgtaaacgtcctgtcttgtgctttggttgatttccaggcctttcacattttgcggcatttcccctttaaatgccgattggtaaaggctgttcaccagttcttgtgcacgctggttttccgtttttgaagcggctgcggcatggacgggctgtgtatccgaaaatgcttctgctccgaaagcgcatcccgtgagcatcactgccgataatcccgtgacgagtgtttttttcttcaacatgtgaacgcctcctttttaccgctcatacccgtatgtttcctgagataaaccagatgttttagtgaaaggccggttgggaatcatagaggatgtatagaggggtacagaaaggggaaaagaaaatggctgatacaaagaaagttacaatcaatggggttgaaatggaagcgccggacggtcaaaccgttttgcagcttttgaacaatagttcaattgacgtgccgcacgtgtgttatcacccgagtctcgggccgattgaaacgtgcgatacctgtatcgtcaatgttaacggggaactggtgcgttcgtgttccgcgcaaataaaggacggagatgtcatcgatacgctttcgtccgatgtaaaaaaagcgcaggttatcagcatggacaacattttgcacaaccatgaattgtactgtacggtctgtgattacaacaatgggagctgcgaagtacataataccgtaaaggaaatgaaaatcaatcatcaaagcattccgttcgatcaaaaaccgtatcctaaagatgaatcaaatccgttttaccgatatgatcccgatcagtgcattttgtgcggacgctgcgtcgaagcctgtcaggacgtacaggtaaccgaaacgttaagcattgattgggagcggaaacgcccgcgggtcatttgggatcaggatgtgccgatcaatgaatcatcatgtgtttcctgcggacattgttcgacggtatgtccgtgcaatgccatgatggaaaaaggcatggaaggcgaagctgggtatttaacaggcattaaccaagagacgcttcggccgatgattgacatcacaaaaggcgtcgaaaccggatacggatcaattttagccatatcggatatggaatcggccatgcgggatgaaagaatcaagaaaacgaaaaccgtatgcacatactgcggtgtcggctgcagttttgatatatggacgaaaggaagagacattttaaaggtcgagcctcaggctgaggcgcccgcaaatggaatttcgacgtgtgtgaaagggaaattcggctgggatttcgtcaatagtgaaaagcgccttaccaaaccgcttatccgggaaggagactcgtttcgggaggcggaatgggatgaagcgctgcagctgatcgctgataaatttaccgatataaaagaacatttcggcccggacgcgcttgcttttatcacatcttccaagtgcacgaatgaagaatcatacgtgatgcagaagcttgcaagagccgttatcggaacaaataatgtcgacaactgctcacgctactgccagtctcccgccacggccggattgttcagaacggtcggatacggcggcgattcaggatcaattacagatatagaaaaagctgagcttgtgctgattatcggttcaaatacatctgagtctcaccccgtcctgtccacacgcattaaacgttctcataagctgcacgggcagaagctcgtcgttgctgacttgcgaaaacatgaaatggccgagcgctccgacgtgtttttccagccgcgtgccggatcagatattgtctggctgaatgccgtatcgaaatatctgcttgatcacgatttggcggatactgcatttctgaaggagagagtgaacggattagatgaattcgtgaaaagccttgaaccttatacgatggaatatgcggaaaaacataccggtgtggacaaggataccttaattaaagtggcccggatgattcatgaagccaaaagtgtatgcgcactgtgggcgatgggggtcacccagcatatcggaggaagtgatacgagcacggccatttccaacatgcttcttgtgaccggaaattacggaaagcccggcgcaggctcatatccgcttcggggccataataacgtgcagggagccagtgatttcggcagtatgcctgacagcttccccggctatgaaaaagtaacggatgaaaaagcccgcaaaaagtatgaacagggctggggaacagacctgccgaaagaaatcggaatgacaaatcatgaaatgatcgagggcatccactcgggaaaactgaagtgtatgtatgtaaaaggggaagaaatggggcttgtcgactccaatatcaaccatgttcatgccgcctttgaaaagcttgatttcttcgttgtgcaggatatttttctctcgcggacggccgagttcgccgatgtggtgctcccggcaagcccgagccttgaaaaagaaggaacgtttacgaatacggaacggagggtgcagcgcctttacgaagtgtttgaaccgctgggcgattcaaagcctgattggcagatcattacggacatcgccaaccggctgggcgctgattggcgctatgaacatccggcagacattatggaagaagcggcaatgctttcgccgctctacgcaggcgtcacttacgaacgtctcgaaggctacaattcactgcaatggccggttgcagcggacggaaccgattcaccgcttttatttacggacaagttcccgttttcagacggcaaagcgattctatatcccgttcagtggaccgagccgaaagaatttggtgaagaatatgatatccatgtgaataacgggcggctgctcgagcattttcacgaagggaatctgacttaccgatcaaaaggaatatccgaaaaaacaccgagtgtgttccttgaggtctctcccgaactcgccgaagaaagagggctggaagacggaacgcttgtccgtctgacatcaccgtacggaaatgtgaaagtcaaatgcgtcatcacagacagggtaaaaggcaaacaagtctatctcccgatgaacgattcaaaagacgccgccattaaccttttgacaagcagctatgcggataaggataccgatacaccggcttataaagaaacatcagcgaagatggagattttgaaaaaagaaggcgttaatccgcttccgaaaatcaatttccgttacggaaacccgcagccgcagatcggtgtccgggttgatcggaaatgggcgcgtcaagattatgtatttccgggagacgccgtaaaaagggggaaacagcaaaatggctaaagcaatcagcggcatccgaaaacagatcgtcacagaagaagacaaacgaaaaaaggacttagaagagatcgagacggctcttttacgaaataaagacgcgattttggaatctttgcacattcttcagcacatgaacgagcgcggcgttttggcgcttctgcgcgggctcttcggccaaggagacaaagtgatggatattctggtgaagaaggcgaatacgccggaaacggccaatatgctgaaaaatctcctgctgttaagcggcgttctcggcatgctcgatgtaaaacagcttgagccgtttatcgttaaaatcaatgcgggcgtcacaaaggccgtcgaagaaaaagacagcggcaggaagacggggtattttgatatcgtccgcgctttaaaagacccggaaatcaacaaggccgtcactctgctgttttcttttctgaaaggcatgggcgctgatacggacgatatggaaagaaatacgcagcctcctgaagaccaaaagcagcaccagaaaccgcagacgaatgagtgagcatttctcccgagcctggccgaaggctcgggttttttgtgcacttctgctgttttcttgggagaaatttcacctccggattcatgacttttgttgtgttatgttaatagttaaggttatgaatagaaaaaaattgaaaatatgtgctaggataaaattcaaggtacgtcaactattcaaatatgaaacaatcaggagtgatgtaacatgagtaagctgaggagcacgagacaagccatccaaagaaccctgatgaaaggaaaaaacggcctggacgtatacaacccttttccttggtatgaaaaaatgagacgggaaagccctatatactttgatgaagagacgaaggtttggagtgtgtttttatacgatgatgtcaaaaaagtcatcagtgataaagagacgttctcaagccgcatgactgatgtgaaaagctcgattgcaaagtccatgctgaatatggacccgccgaaacatacccaaatcagatctgccgtcaatcgcgctttcactccccgcgtcttgaaggaatgggggccgagaattaaagacattaccgatcatctcctgaaacaggcaaagaacaaagggcggattgatatcgttaaagatctctcttaccctttgccggtcatggtgatttcagaattattaggcgttccgtccgaacgtatggatcagtttaaaaaatggtcggatattctcgtcagcatgccgaaagatgcgagtcctgaagcggcggagaaaaatcagcaggaacgtgaccaatgtgaggcggagctggcggcgttttttgcgggaataatagaaagcaaacgaaaacagcccggccaagatattatttctattttgataaaagaggaagaagagggagagaagctcacgccagaagatctgatcccgttttgcaatctgcttttagtggcgggaaatgaaacaacgactaatctcatttcaaatgcggtttacagcatattagagacgcccggcctttatgaagagctgagacaggacccttctctcatcgcgcaaacggtggaagaaacgctgcgttttcgcgctcccgctccgtttgtcagaaggacggtccggcacgacactgagctgcgcggacgccgcttgaaaagcggagagatcgttctctgctatgttgcatctgccaaccgtgatgaaaacaaatttgagaaggcgggcgtatttgatattcatcgccaatcgaatccgcacctttccttcggattcggcgtacacttctgcttaggcgctccgcttgccagacttgaagcggaagccgcgctgaaaggaattgtaaaaaccttttcacaccttgagcccgtccggattgagccgatccgaaacagtgtcatgtacgggctggagtctttagaagcggagataaacgaaaatgaaggagaagaaaaaagatgagaaaaacacacatcgccattattaatgtggccgctcacggtcatgtcaatcccacgctgcctgtggccgaggaacttgtcaatcgcgggtataaagtgacattcgctacgactgaggaatttgaagcttccgttgccaaaacgggtgctattcccgttttataccgcacaagcataaaggcggacccgaagacgataaaagaacgggtaaataaaagtgacgcgtttgtaatgtttctggaagaagcggttgaagtgcttccgcagctggaagagctgtacaaagacgaccttcctgacatcgtcctgtttgattttttagcgcttgccggaaaattgtttgcggataatggcggcatcccggccgtaaagttctgcccaagctatgcaatgaatgagtattttcaattaggaagagacgaagaaacgatggaagcggccaaacaggcgatagaagaatatcaggagaaaattgaaaatgaacaagtgaaacggatgacaatggaagaatttttcatgcctgaaaaattgaatatcgtctttatgccaagggcctttcagccgaaacaggaaacctttgatgaacgattctgttttgcgggtccgtctcttggagaacgcacaaatacgggaagtctggaaattgatgcagccgatgaccgtccgcttatgctcatctcactgggaacggcgtttaacgcctggcctgaattttaccggatgtgtattgacgcgtttcgggactcggactggcgggttattatgtcagtcggcacaacaattgatccggaaagtttttcggatgtgcccgatcactttatcatccgccagcacgttccgcagcttgatgtgctggagaaagcaaagctgttcgtatctcacggcgggatgaacagtacaatggaggcgatgaatgcgggtgttccgctcgttgtcgttccgcaaatgcacgaacaagaggttaccgcaaagcgtgtggatgaattggggcttggcgtgcatctgccgccgaaagaagtcactgtggcccgtctgcaaaaagacgttcagaacgtatacagcgataaaaacatcctcagccgcgtgaaaagcatgcagcagaaaataaaagaaaccggcggccccaaacaggctgtttgcgccattgaagaatttttggaaaaggcgtccgtcgaaaattgattaggaaaacaggcagcaccggacggctgcctgttttgttatatatttttcttcatgccgcatctccggcattccctcaaaaattttccacccttcactgaacttttaaacagcgtgtaatcgcaattgtcacatcggccgctgtgaacatcaggatattcattgaactcataaatgaccgaagtatcgtatccttttgtctcgaactctttttttgtttccatgattgaaagtccctccgcgaatcaaatcgttctgcccggttaatgatacagcaactgcacgggggattcaacgggagcatagcttgattttcccggctgattgcgtaacaataatagaaataaatgacggcctgccatagggcgcccggcatctgaagggaagaagaaaacagcgatgggaaaaggattgaacgggaaacggattgccatcggcggttcgcggaaaacagaagagatcacaaaattaatagaaaagcagggcggaacggcagtcatccgttccctccaaggaaccgtatacctggcggaggatcaaatggaacccgacgtaagaacatttgccgagcaaaaagctgactgggtgatattcaccacaggcatcggtacggaaacgttattgtcggtatcggaaaaaatcggtctgaaagaagaatttttagcggccgttcatgaagcgaaaatcggctgcagaggctataaaacatatgcggccttaaaaaagctcggcatcacgccgcatgcctcagatgaagacggtacaacaagagggctgatccgctccttggaacgatttgactttaaagataaaaaagtcatgatacagcttcatggcgagaaagcgccggttttaacggagttccttgagaaaaacggagcgaaggtattccctgttctgccgtatcagcatattccgcctgaaagggagacggtcgataaactgctgggagagctgttaaacggagaggtcgatgccgtatgttttacgacagccattcaagtgcgctctctctttgattatgcaaaagaaaaaggatccgcaaaagaattgcagcaggcattcgaaaaacacgtgcttgccgccgcagtcggtaaagtgacggctgaagcgatccgggatgaaggggtaaagagggtccttgctccggacattgagcggatgggagcgatgattattgaattatcccgttactatgaatctctgaccttgtcatgaaccaccattcagcagggaaaaagcttacgcttccctgctgaatttttttaattgccagtgttccgtgaaaagggaaggatatgtcaaggcgctgagtatgatacatgtaagaagagcggaggccatcgttgtaaaaacgatcagcagctgaaagcgcaccgcctgtatcggatcagcccccgctaaaatctgccccgtcatcatgccgggaagctgaacgagacccaatgttttctggctttcaagcgtcgggatcatactgagcttcatactggacgtcaatatctgccggacggcctgcttaggcgttcctccgagagagagaatcagctggatttcttctttccgcaggtctgcttccgaactgagccggcttaaaaacaggcttgagagcaccatggagtttccgatgaccatgccgcttatcggaatgacatatcttgaagtgaacggaatgatgtgaagggtcagtaaaagtccctgcgtcacggtttccgcgattgccagtgtcagaaaaacgcgccaaaatgagccgatccgcatttttttccgtttggcgacattgtgcgaagcggccgtgagcatgagaagcaccattaatatgataaatatcgggtgatcaccgcgaaaaatcagcgacagcacatagccgatgatgagaagctgaatgacggccctgacggttgcgacgatcatatccttttcgacgccggctttaaaagatttagacaggaataaagcgataatgacaaatatacttgttagtaacagtgaaagatcattcatatcagcacccgctcccttgtaaaagcgcccgggccttttcgtgtttcggttccttaaagaacgttttcgtttccgcggtctctaaaagccgtccctcagccataaaccataccgtatcggataatcgttccgcttgttcaaggttatgggtgatccacaggattgtcagctgtttttgccgatggagtttcgtaatcagtttctcaatggtgagaacggatgaggggtcgagcgccgaggtgatttcatccagcagcaggatggaaggcagtccggcgagagttcgcgctaatgagagcttctgccgctgacctccggataattcttttgcattccgatccagaagcccgcgcggaaggtctgtaaaatctgcgagctcttcaggggtatagtgctgcgccccgtggagtttttctgcgagcagaaggttgtcccgcaccgtgccctccgtgacgggagctgattgaaatgcaaggcccgcggtttttctgagctccctgatatcccagcgccttatttcttttccgaatacaagcacttccccttcatcaggtgtattcatcagattgcaaagtgacagcaatgtgctttttcccgcgccggaaggccctatcaaggccgtgatagaacctttttgaatatgtccggttacacggctcaggacatcaaaggacgtattgttttgttcaaggcgtttgccggctgacagaaaagatattgccggaatttcttctttcatttgggatgacacctttcgtaaaaaatcaggaaccagtgagattggctgacgtttgctccgccgttttctggtctgtctgccgggaagcgaatgtatgcatgaccattcccccaataataatgaacagtccggcaaatgaaagaagtgacggaaacgctgcggataaaaagacgatttcgccgatcagtgcaaaaagaacctctccggactgtgtcgcttcaacagcagcgagcttctgcggctcattcctcaccatatcggtggcgcggaaaaataatactgttgcgataacgcccgagctgagtgcgacgataaaggattggaatgtctgtcccattgagggaagcccgtctctatgccagccgaaagcggcgatcaaaagccaaaacggaaggcttgcgagcgtcatgccgagcacccgctgaaacgtatcgagttttccgccgtattgttccagcattttgcggttgccgagcggataggcaaacgccgcgatgacgaccggcgccacgctgaatagtatcgtgcggcccgacagagaacccgcatgctgaagctgaatcagcccggctccgatcaggatgatgacggaagtaaccagcgaaatcagcgggatcttttgtctgacggaaaccgggcccgccggtgaattttttgtttcatagaaaaacggcgacagaagcacacccgcgacaattgtaatctgccacgtgccggcgatcagccagccaggcccatatgccgccgcaaacgtaatcggggcataaaaaagcacgaacccggtaaaactccacttcagccaaaaaaacggttttttccggatttcatgccagagcggcgcccattttcctttcgcataaacgatcaaaaataaaaacggaatcataaaaagaaaacgcagggaagagctccacatccagcttccgccggaaagctccatcgccctgtttaaaataaatgtgactgcaaaaaacagagatgccaatattccgatcacgatggctttcattaaatccctcattttgacacatatttttttatactatactattcaccggcaggcttcgcaatggaatatgagaaaatagcgttttaataaatgatgaatgggaaacagacatatacggaggtgaacacaatgcagaaagaggatattcaagtgctttatttcgaagatgacggccgcattccgaataacccgaatcttccgcttgttatttataaagcggtatttaatgaagaaacggtacagaaagcagagtccgtcctccgccggcacgattggtctaacagctggacgggcggagtatttccgtatcatcattttcacagcaccacgcacgaagttcttgtcgcggtaaaaggaaccgcggttttgaggttcggcggggaacaaggggcggacgccgttcttcaaacgggagacgcagcggtcattccggccggcaccggacataaaaaactgtcgggcagttctgattttaccgtgatcggagcttatccgggcggccggcagtacgatacaaaaacggagaaaaatgatagaacttcagaagaaatcagccgtgtcccgctcccggaatgtgacccctttacgggaaaatcgggcccgcttttaaaattgtgggaaaaatgacaggggaaaagcggacggtctgtaaaaaaatagcctaaaagaaacgttattacacccccgccatataaataatttcataaacgaaacaattcacgttcaaattttgttcaaaaagtgttattatataagagtaaatcaaattggggttttttatgtttgctattttcagagaggaaaaagaaattttgacttattcaattgtttttgttgatataaaaataatactggatatggcaaagtgaaaaactgggtagtaaacatttatttttgtaaatgattgtgcatgaattcacaatcttgctttttcatgcttttctgcatgaagggggaaaggctaccctttccaaaaaaatcagcatactgcttatagtaaaggagaatcggatatgccagaaacaatcgatcaaacaaatgcatctgtcagccaaggccaacgcgatcttattgatcagctgctaaaacctgaagttcaagaatcactgactgttttagtggatcagcttccaaaactgactgagttagtaaatattttaacgaagtcttatgattttgcacagtctgtagcgacagacgaagtattgaagagcgatacagtgggtgcgcttacagaaattcttgagccggtgaaagaaacagcgaaagaagttgcggctactgcgatcgaagcaaaagaccgcgcggatgcaagcaatgaaacgatcggacttttcggcctgctgcgcatgctgaaagatcctcaagctcaaaagctgttccgttttgctaacagctatcttgaaatcatgaacgaaaaacaaaaataatctcagattcaaattgatataaaggacggaggatatacgatgtcaaaacatattgtcattttaggcgctggttacggcggagttctttctgctttaaccgttcgcaaacattacagtaaagatgaagcacgcgtaaccgttgtgaacaaatacccgactcaccaaatcattacggaactgcaccgccttgcagccggcaacgtgtctgaacaggctgttgctatgccgcttgaaaaacttctgaaaggaaaagacgtcgacattaaaatcgcagaagtcaattctttctcagttgataagaaagaagttgccctttctgacggttctaagctgacttatgacgcgcttgttgtcggacttggttctgttacggcttatttcggcattcctggacttgaagaaaacagcatggtgctgaaatctgctgctgatgccaacaaagtatacaaacacgtggaagaccgtgtgcgtgaatactctaaaacgaaaaacgaagctgatgcaacaatccttatcggcggcggcggcttaacaggcgtcgagcttgtcggtgagcttgctgacatcatgccgaaccttacgaaaaaatacggcgtagatccgaaagaaatcaaactgaaattagtagaagcaggtccgaaaattcttcctgttcttcctgatgaccttatcgaacgcgcgacaaaaagccttgaaaaacgcggcgttgagttcttaacaggtcttcctgttacaaatgttgaaggaaacgttattgatctgaaagacggttcaaaagtcgttgccaacacatttgtatggacaggcggcgtacaaggcaacccgttagtcggcgaatccggccttgaagtgaaccgcggccgtgcgacggttaacgatttcttacaatctacttctcacgaagatgtattcgttgtcggagacagcgctgtatactttgcgccggacggccgtccgtacccgccgacagcgcaaatcgcttggcagatgggtgaacttgtcggttacaacctgttcgcttacttagaaggaaaaacgcttgaaacattcaagcctgtaaactctggtacgcttgcaagccttggacgtaaagacgcggttgccatcatcggagcgaactctactccgctgaaaggccttccggcatctttaatgaaagaagcaagtaacgtacgttatttaacacatatcaaaggattattcagcctcgcttactaatccttaagatcacacagaagacattgccggacttttctcggcaatgtcttttttacatgaaaatgttaacggatacaattttctgaaaaataaaataaaaatgattgatatgtgagaaagaggaagctaaaataaaaaagaaccattttgttaacgttaacattttttaagagggaggatgagagtgtgaaagcttttatgggtgatgactttttactggatagtaaaacggccgtaaagctgtaccgggaatacgcagaaaacatgccgatcattgattatcactgtcacttaagcccaaaggaaatctatgaaaataaaaccttcgcaaccattacggaggcatggctttacggtgaccactacaagtggcggatcatgagggccaacggcattgaagagcgctgcattaccggaaacgcttcagatgaagagaagtttttcgcctgggcaaaaacggtgccgatggcgataggcaatccgctgtacagctggacgcatttagagctgcagcgctggttcggcatttatgacgtattgaatgaaaaaacggccgcggcaatttggaaaaaaacgaatgagctcctgcagggagacgggtttggcgcaagggatctcattctgaaatcaaatgtcaaagtcatttgcacaacggacgatcctgccgatgcgctgacataccatgaactgttaaaagaaagtgattttccggttcaagtgctgcccggatttcggcctgacaaaggactggacatcagcagcccgggttttgccgattgggtccggtcgctggagagcgcttccggaatggctgtcaccacctaccaatcgtatttggatgcattggaatcccgcatccgcttctttcacagtgccgggggaagagtgtcggatcacgcattagatcaaatggtttatgccgagacgaccgaagaggaagcggcccggatttttgccgccggattaagtggagagcatgtgtcttttgaagatgaaaagaaattcaaaacacggacgctgcaatatctttgcggtctttacgccgaactggactgggcgatgcagttccatattaacgcgttaagaaataccaatacaaataagttcagcagcctcggtcctgatacgggatatgactcgattaatgatgaacgtatcgcaaaaccgcttgcccggctgttagattccgccgaaaaaaagcggcaattgcctaaaacgattttgtattctctgaatccgaatgacaactatattatcgccagcatgatcaacagctttcaggatgggaaaacaccggggaaaattcaattcggcacagcctggtggttcaatgacacgaaagatggaatgcttcaacaaatgaaagcgttatcaaacacaggtctgttcagccgttttatcgggatgctgacggattcaagaagtttcctgtcatatccccgccatgaatacttcaggcggcttgtctgcacgctgatcggcggctgggcggaacaaggcgaagcgccctgcgatatggagcttttagggaggattgtcgagggaatttgttaccggaatgctgaggaatatttccgcttttaaaaaatggaatgaaagaggtggcctatgagtaatgtgcctgtcgtgacagcacctgccgcaaaagtgaaggagcataagctgagtctgaaagaaaaagtatcctatggtttcggagattttgggaacggatttatgtttgatctcgggcagatctatttgctgaagtttttcacagatgtcgcaggcattccggcagcgttcgccggcagtatttttttggtcagcaagctgtttgcggctttgactgatccgattgtcggctcggccattgactacagaaaaaagatcggaccccgggggaaattcaggccgtacttattattcggaagtattattcttgcggtcatgaccgtattgatttttgtgtcaccggacgtgagtgtcacctggaagcttgtgtacgcctatgcttcttacatgctgtggggggtcgcttattctttcgtcaatattccgtacggctccctcggtgcagccattacacaggatgcggaggacagaacggcgctttccgcattccgccagatcggctctctcggcgcgctgctcattacaagtgtcatcgtcatcccgattctcgttcattttgataacgttcacatcggctacccggcagttatgggaatgatggccgtaatcggaatcgcgggatttatgatctgctaccgaaactgcaaagaaagaattatcgtccgtgaagcgccgaaagaaaagctgtccgtcatgtcggttttcaaatgctttatcggcaacaaaccgcttctgactgtcgttttcatgacgattttctcaatatcggcatataacattaaatccgctatgcttgtttacttcgcccaatacaatctcaacaatgcggagctgatgtcctacatgagttttatcatcatcggttcttcatttttaggtgtgttgtttatgccgaaactcgtcaaacgcttcggaaaaaagcaaacagtgatgatcggttttgccgtcagcgccgcggctgatgcgctgaatttctgtctcccgtcaaatgtatatatctttacggcgttagcgagcattgcttttatcgggatcagcataccaaacggcattacgtgggcgcttgtgtcggacattattgattacggagagtggaagacgggtgaacggaaggaggcgacgacatattcgctttttaacttctccagaaaactcgcccaatctttatcaggttttctttcaggcatcgggctgagcgttatcggctatatcccgaatgcatctcagacaaaaggcacgttaatcgggattaaagggcttctgctgctgtacccggctttcgctttagcgtgcgccatgctgattatcggtttaatgtataaactgacggaccggcagcatgccgagctcgttcaggacttacatcatgcaaaacctcaactttagtgattttatggactgtccgttaatggtacaatagaaataaatgacagcatacagaaagaaaggaaaaacgatggtaaccataaaagatatcgcaaaactcgccaacgtatcccacacaaccgtatcccgggcacttaacggcagcccctacattaaagagcatacaaaacagaaaatattagagctcgcttcacagctgaattacacaccgaatgtaaatgcaaaaagccttgccatgcaaaagtcccatacgatcggactgttttttacaagcatcaccaacggaacctcacacagctttttttccgataccatcaaaggtgtaaaccgcacaatcagtgaggaatacaatttgttcgtccgcgcgattgacgatctgaaaagctttgaaaccattacgcccatgagatatgacggaatcattttaatgagccaaagcgacagtgataattcatttatttatcatatccgcgagaaaaacatcccgctcgtcgtgctgaaccgggacattgatgaccggagcatcacgaatatcctgtcaaacgataaagaaggctccagacaggcggtcgactgcctgatcgcaaacggacacagagatatcgcgatcattgagggaaaggaaggattcaggtcaacttctcagcggaaagaaggctatttgacatctttaattgatcattctatcccgattaagcatgaatacagtgtaaaaggccgctatgatatggaaagcggcagtcaggcgatggaaaaacttttggcgcttcaatcaccgcctacggctgttttttgttcaaacgatgatatggcgatcggggcgatgaataccattttcgccaaaggcctgaacgttccggaagatatatccgttatcgggtttgatgacatcggcatttctcaatacatgacaccgaggctttcgaccgtaaaacgcccggttgaaaaaatcagcatactcggcgcagagaagattttggcgcttatcaccgacccggatacggcggcggaaaaaatatacgaaaacaccgaggtgatgataagagactcaattaaaaaactcacataacagcccgtctgaatatccgggttttcgtacgggaaaatgttaacgtgtgcataaatgcagaaggaggcggacagcttgcggcagctgaataaaaagatgttggttgaatacattcaatatcctgaaaaagtccttcagttcggcgaaggcaactttttgcgggccttcgctgattggcagatcgatcaattgaatcaattgacggattttaacggaagcgtggtcgccgtacagccgagaggctctgagaaaataaaacgtttaaacgaacaggacggtttgtttacgctttttttgcaggggataaaggacggaaaaccggctgaagaacacacgatcgtcaaatccatcagccgcggcattgatcttttttctgactatgattcctttaaacggctggcagcacaagaggatcttcgttttatcatctccaatacgacagaagcgggaattacgtttgagaaaggcgaccggcttgaggatagacctcaaaaaacattccctgggaaattagcggcgttcctttatttccgctataaggcatttgcgggtgacgccgagaaagggtgcattgtgcttccatgtgaactggtcgaagaaaacggacggaaactgaaggcggccgtgcttcaatatgccgggctgtgggagctggagcctgattttactcaatggattcatgatgcgaacattttctgcaataccctcgtggatcggattgttccgggatttcctgttgataccgctgaagaacttaccgattttctcggatacgaagaccgtctgcttgtggtcggtgagcattattatttgtgggtgatagaagggccggaacagcttcagaatgagcttccttttgctgatgccgggctgaacgcactgatcacgtctgaccttacgccttacaggacaaaaaaggtgagaatcttaaacggcgctcatacggcattggcgccagtggctttattatacggactgcaaaccgtccgggaagcggctgagcacgaggtgacgggcagattcatcgaagagctgatcaatgaagaaatccttcccgtgctgcaaatggagggtgtcacccagtatgcggcagatgtgttacaccggtttaaaaacccttatatccaacattatctgcaaagcatcacccttaacgccgccgcaaaattcaaaacaagaaacctgccgacgctgaaggcttatatcgaacaggagggccggcttcctgagaggctggtattttcattcagcgccatgatctattcatactggaacgggccgaacaaaccggcagacggcgaggaggttctgaaccgttttcaaatggctcggtcccgttgcaaagatgatatgtttcaagcggcatttactatattaggagaagagcgactgtggggaaagaatctgaaccatcttccgggactgactgaacgaacggctttttttctctctgtcattcataagcgggggatgaagcatgcgttacatgaatgctgcggcaataaataagggggaagtgaaatgaaagaggtcataaaaatccataaaaacgataacgtgcttctcgctatgcgccattttaacaaaggggagcggctgcatacagacggactgacgattgaagtgaaggaccctgtaaagcgggggcataaaatcgcgctgcaaaccattgaagaaaacggcagcatcattaaatacggtttttcgatcgggcgtgcgacaaggcggatttcggccggcgagcatattcatacccataatctgcaaacaaatttatccgatgtgcaagaatacacgtattcaccgcgcttcgaggacaatccttttacaaatgagaaccggacatttcaaggctacaaaagagaaaatggtacatccggcgttcggaatgaactgtggatcgtgcctacagtcggctgcgtaaacggcgtcgctgagaaaatcctgcagcgcttcgtaaaagaggcgaaagacattgccccctttgacaatgtgctggttttaaaacaccaatacggctgctcccagcttggcgatgatcatgagaatacgaaacaaatgctgataaacgccatccgtcatccaaatgcgggcggtgtgctggttttagggctgggctgtgaaaataatgagctggcggcaattaaggaaacgctttctgaagtgaacggagatcgggtgaaatttctcgaatcacaggctgtcacagatgaaattgaagcgggaacagcgcttcttaaagagatacaccttgcggcaaagggagataaacgtgaggagattccgctgtcagaattgagcatcggattgaaatgcggcggatcggacggtttttccggcatcaccgcaaaccctttattagggagattttcagattacttgattgcacagggagggagcacggtcttaacggaggtgcctgagatgttcggcgctgagacgattctcatgcagcgtgcggcgagtgaagaagtgtttcataaaacagtccgattgatcaatgatttcaagcaatattttatgaagcacgagcagccgatttatgaaaacccgtcaccagggaataaggaaggcggcatttcaacgctcgaagacaagtcgctcggctgcacccaaaaagccggtcttgcaccggtttctgatgtgctgacatacggtgaaacactgaaaacaaagggattgacactgctcagtgcgcccggcaatgatttaatcgcttcttcggcgctcgctgcggcgggctgtcacctcgtgttgtttacaaccggaagaggcacgccgttcggcacatttgtcccgactgtgaaagtatcaacaaataccgatttatttcaatcaaaacctcattggattgattacaacgcggggagattggcggaagacgaaacaacagaagatcacattgtaagagattttattcaatacattattaacgttgcaagcggacaattcgtcaataacgaaaaaaacgattttcgggagcttgcaatctttaagtccggtgtgacgttataagagaaaaggcgatctgacaacagaccgccttttttagattaattttatcccgctgattaaaataatcgccgccatcacaaactgcagcgggcgcggtgagaatttcggcgaaaagaagctgccgagaagcacacccggcacagagccgatcaacagattcaatacaagcaggtaatcgacgcttccgaagcttgcgtttaacagaccggcaacagttacgagcagaaaggcatgtgcgatatccgttcccaccacttctgccgttttcattctgaacaggtataacatggcgatcgcaaataatgagccggacccaatagatgtcaggccgacgatgaagccgaaaatgacgccgatcagtatcatgagtgtccgcttttcttcaagtgttttttgctgccagcggttcggccgcagttttttatcgaaaaaaaggcgggcgataatggaaatagcgacaagggtcagcacgtagccgagcgcctgtttgataatctgctcctgatgctggtgaaaagcgggaaacaagtgaagaataccgatggcggctgttgcgctgggaatgctcccgagcgccaagtagccgacaagtttaaattgaacggtgcgctgcttccaatgagaaacgacaccgaacagtttggtgatggaattatataaaaggtcagtgccgacggcgattgaggggttgatccctaaaacgatcagtaaaggagtcaaaagcgccgctcctcccacacccgtcaatccgaccagcgttccgacaaagaaacccataaacacaatgcttacagtcatctgtgtgcctcctgaataatcctactatttttatcagattatatatgattaagaggcggtaatcaattaaattttcggaaaattttatacagaacaaaaaaatccgcctgcctgctgttatttcgcagatcggcggatgatggccggattatgatttttgctgataaaacggaagttccgtgtggcccatttctctgacatacacgaaaagattgcctttatgatgaatttcatgctccatggcaagctgaaggagagccgcgccggttatttttctgccgaaagaggcagtcaggtcaatttcgcggttcagctgctcttcagtcagctgtgacaggatgtttgtcgttttttcagtacatgcttcagccagtttgacgaggtctgtttccgcttcttctttcggtttgttctggatagctgatccgtttccgtcgttaatgacgtttgcaaacataagaaaagaataaacgatgtgttttacaagttcctgagcggacattgatgtctctgccggcttgtagtcgtaatgctcgcggctgattttttccgccagctcaatcgtcacgtttcgatgtgacagaaagtggctgaccaattgattttgtgctgtcatgtgaaaacccccatttaatacagaataaaagctgcaaggatatgctatatcaacggcacggaagaaacaagcaataagcttgtgatggagataaatcgttgcggatatccgaaattcgacaattgcggtctttttgcgttcttctttttctagcaattatgataaaatatgacatatctcggtcattccaaaagggggatttattgaggatgaagcagactattccgtcctcttttgtcgggctcaaaattaatgaatggtatacccatatccggcagtttcacgtccttgaggcggagcgcgtcaaacgtgaagtagagagagagattgaggatatggaagaagatcaggatctgctgctgtattattcattaatggaattcagacaccgcgtcatgctggattacatcaagcccttaaaggaggacccttctcagcctgagttttcagaattattggaagacattgaaggcaaccagtataaactgacaggactgcttgattactactttaatttttttcgaggaatgtacgaatttaaacagaaaatgttcctaaacgccatgatgtattacaaacgggctgaaaaaaaccttgcactcgtttctgatgacatcgagaaagctgagtttgcttttaaaatggccgagattttttacaacctgaaacaaacctacgtctccatgagttatgccgttcaagcccttgaaacgtaccaatcgtatgagacgtacaacgtccgcagaatccaatgtgaattcgttattgcagggaattatgatgacatgcagtatccagaaagagcattgccccacttagaacttgctttagatcttgcaaaacaagaaggcaatccccgtcttatcagttcagccttatataatctcggaaactgttacgaaaaaatgggagacctctctaaagcagccgaatattttgagacatccgtttccatttgcaggtcagaaaagttcgataatcttccgcgttctatttactcattaacacaggttctttataaacagaacactacagccgaagcagagaagcaatatcgcctcgggctcagtatcgcccgcgaatacaatgatgaattgtttgtcaatctgttccaatttttgcatgcgttatacggcaaggaaatggataacgcatccgtcaggcacacgtttgattttctggaagaacacatgctgtatccgtatgtggaagaattggcgcatgacgctgccaaattttacatgaaacacggacagcctgaaaaagcgctcacgttttatgaaaaaatggtgcacgcccaaaaacaaatccagagaggagattgtctatatgaaatctaaactattgtcaggattgctgcttgttgctgtcgggttcagctttacacaggtgatcggccatgaaagccatttggaaaaccaagcggacggcacattccatattgccgcgcgcaaccaaacataacataaagacccttctttggaagggccttattttttgcatgcgtatccattccatttttatccgaatgcagggtctatatactcagttatctgtcctacgaatgccacctattgatgaaaaaggcataaggagagatgaagagtggggattgaagtgaaaaaacggctcgtatcggctgataaatatgcgttaaaatgtccgaatccgatgacgccggagtatattaccattcataacacggcaaacgacgcatccgccgctaatgaaatcagctatatgacgggaaacagcgaatcaacgagctatcattttgcggttgatgacaaagaagtgatccagggaattccgttggaccggaatgcctggcattcgggagacggcacgaacggtaccggaaaccgaaagtcgattgctatagaaatctgttacagcaagtcaggcggcgaacggtacagagccgcagaagaactggcgattgcgtttgcggcgcagcttttgaaagaacggggctgggggattgacagaatcagaaagcatcaggactggaacggaaagtactgcccgcaccgcattttgtctgaaggccgctgggatgaagtgaaggcgaagattgaaaagaaattaagcggaagtatgacggcgaaaaaagcctctatttcttcttccgcgtctgagtaccatgtgaaaaaaggcgacaccttatcggaaatcgccgcatcgcacggtgtcagcgtaaaatcgctgcaaagcatcaaccatatcaccgatcagaatcacattacagtcggacaagtgatcaagctcgctcagacgggttcttcttcaaaaagtcaggctgtgtcttcctatccgcttccatccggtgtgatcaaagtgacgaaaccgctgacgaaagggacaaacgtaaaacaagtgcaaaacgctttatccgctctttatttttatcccgataaaggagcaaaaaatcatggggcggacggcgtttacggcccgaaaacggcaaatgccgtaaaacgttttcaatccgtcagcggattaacggcagacggaatttacggcccgaaaacgaaggcgaaaattgaagaaaaactgtaatcaagaaaacggaagctccccgggcttccgttttcttcttacatacaaactgcggcaagggccttttgaatatcataaatgctttcatcttttttaaactgctttgagacagcgggaagttccgcgcctgaaatccaaattttcagctctgaatcaaggtcgaagcggccggcggtttctacgctgaatctggaaatgctcttgtacggaatggattgaatctccgttttcttccccgtgagtccctgtttatcaacaagaataagacgcttatccgtaaagacaatgatatctcggacaagcttaaatgcggcgttgacattctcaccttccagcaaaatacgggccagttctgcttttgcttcagccgtcgatattgtcgacgcattgcccagcaatccgttgatgaaccccataatatctcccccctgatacgtattctatcaatcatactataaaaaggtttccattcccagatgagtagagtaaactggtgctgactggaaaaggagagcatgttacacatgaaagatagatatgacaatttcgcagccctttccgctgctgaatcggaatacagaattatttatgaagaaaaagagggaagtaaatgtatcgtcctcgctccccacggcggcaggattgagccgggtgtcagtgagctggtgcaggcattttctgaccaaagctcaatttatttatttgaagggacgaagcggtgcgataaccgttctctccacttgacaagcacacgctttgacgagcctctggctttagaaaaagtggccgcccatcattacgcattggcttttcacgggtatcatgatctgaaaaaggcaaatacactcgtcgggggcgcggatctggaaaaagcaagactgatttgtgatctgctgcgtgaagcgggatttgatgccgagctgacagagaagaatgatcggctggcaggtgtaaatcccggcaacattgtcaatcggacaaaaaggaaaatggggctgcaattggaagtgagcacggcgcagagacacgcgctgttcagcaattttggctgccgggtagaaaaatacacgccaaccgatctgttttttcggtatgtagaaaccgtgaaggccggtttttatgataaatgaacagggggcccgttcttacattcactggagctatgcggtgcatgaagtgcttggcgggcagcacggtgattacagcgtcatgatgcaaaaaccttttctccgatgtcaaaatgatgacattctgccggctgtgttctaagccggcggagaatcgctaattttcaataaaatacggcgttttttcttcagcggcatgcaagtgtgtctgtccgcttccataatacacattcggccgcttgtcggataacagacaagcgagccgcttctgaaattgaatacctgctttacgccgttcaaacagctcgagccttttttccgcaaatgatgccgtcacccggaaagcggctgcgattaaaataacggcgtggctcctccgctggggcagctccatgtttaacagcataaaggtcggcacacagaagtggtacataaaatggttggcctgaaattcctgcagttccctgaacagcttgttcatatgaaaatggttcccggtatgcttcagcacatggcacagttcgtgcgcaaaatcctgccattgctcttcgggtgactttttttgattcaggacgatgctgtacatgccgtcccgcttcagcatcatactgtgcgtatcttcaaaatgaatccaaatgtcaagctccttggcaatcatctgcatatcaatatggagaggggcggtcattcccatgcggcaatataagtttttgacgtattcctcaagatgtgttaaaaaatcgcccaattgaatacaccctttcgaacatatgttcttttttaagcgagaaagaaaagccctgatcggactttgaatcaattcccttttcttttaaaaataaacattcagcttttatatcggctgaacgttaagcagtttaaaggaaaagagcggattatttatgtttcggcctgcggtttttctctttttcttttaaataattaatgaattcaatggcctgctgcttgctttccggggaaaagtcctgcatgtcccgatatgcgatctgcaggtcgggatcggcaaacatgtcttcatctgaaggttcttttccggttaacaaataatcagtcgacactttgaaataatccgcaagcttttgcagcgtgtcgtaatcgggttcagatcggccgttttcataatgagaatatctggcgcgcgagacaccgatatgatttgcgacttcttcttgcgttttcttacctctgagactctttaatcttccgcctatcatccgaaatgacctctcttttttcaacaccctaagttacttatgattatagatacaaaatgtatcaaaagaaagagatgataaaaaaagtatcaaaaaggtcttgatgatacgaaatgtatcgtatataatcaacatcatagagatacaaaatgtatcaaaatgcgataagaaattgatcaggagggtgagagatgcagccgataatcatccgtttcagcagcaatccggctgaccagagatgtttaggaaaagcaggcggttcgatatcttttaccgcttgcggactaccggtattccgatttgataaccgattgcagtatgagcgctatatacgtctgaagaaaaatggagacgtcccttatgaatcgtaaaagctacccgtttttcatctattccggattattgaattctgaacattatgacaaaatagggtccgccatttggctgtttttatggttcatcagctcaacgacaaaggaacatgtaaaagacggcgtaaagtgggggatcgtcctcggacataagcccgtaaaagcaagagaaatggccgatgtattcgcggtcagcgaaaaaaccgtcaggcggtggctcgagagcttggaacagcatgagtatatcaaaaccgtccgcgccccttacggactcatcgtctccgtaaagcactcgaaaagattcacgccgaaaaagacattaacccgcccggaagcaactgaccggacaatatcggcggatcaccgggacaaaaatgtccggagagaaatagatataacaaaaaatcatactgctgaagaagcgattaacgacattgccgcccattttatcagattaaggtctgcacaggaggggcggagcgtatatccgtcgccccgggattatcaggccatcgcccgtattgtttccctcggtgcgtcagcacaagaagcaatcaaatggctcggcgaatgctttaccgcttttgaacagcggcgcacctcttcagctgaaacgatcaaggctttcagctattgcgccaagtttatggaagaccgcttgaatgcacgaattgcgggaaggacaatcacaacaaaaaaagagaggaatacgatacatgacaaaacgaacgatcgagcagattcttgccgacctgaaaaacggaaaacgtccattactggcggacagaccggaagaatcagacaaaagccgctttgactgcccgctctgtaaagatcagggcggttatctcaaaaaccagctgggaatggaagtatgggttaagtgccgctgcgccgccgaacggaaagtagaacgcattctcggcgcaagtgagattacagatgcctttcggaagctggatttcaaaggatttatcacgcggggcaagcctcaggcagtcgtcgacgcatatgagtgcgcccttgaatatgttgagaacttcgacaagatgaaaaactgccggaaaaacagcattgcccttttagggcgtccgggatcgggaaaaacccatcttttgaccgctctcagcaattatgtcatgagacagaagcagacaccggtgctgtattttccttttgtggagggctttacggatttaaaaaatgattttgatctgctcgatgcaaagcttggccgtatgaaacaggcggatgtgctttttattgacgatctgttcaaaccgctgaacggaaaaccccgggcgaccgattggcagattgaacaaatgtacgccgtcgtgaattaccgctatttaaatcataagccggttcttatctcgagcgagctggcatgtgacggattggtgcaggttgatgaagccttgggcacaagaatttatgagatgtgcagcgattatttagtcatcattaatggcaattcatttgacgtaaaccacagattagagggggcgagataatgtgtaagctgtgcgggccgaagaaggtcattgtgatggaaacgggtttcggcgctgtctttcacccttgcccgaactgtaaaacaggcactgatttaacgccggtcattaaacggcttgaacgaatggttcaagacgcaaaagcgaggcttgatgcacgtgtgtaaatatatcaaatggcttttttgcctgctgttcagggcaaaacggatagaaaagcaaattgaagcatggcatgaggctgatggaaagtgaggatcaccattgcaagaaaaacacagccccgctccatggcgggccgtacacagcggagaagaaaaacccatttacatttattccgcttacagcgaagcggataaagagaagttcccttattcaaacggaaggctcatcgcggccgttttcaacttaagttcatactcacagcagatcaacgcggcattgatggcgaaagccccggaactctttgaggcggccgaaacggctctccgcctgctccggggagaaagttctgaagaaaaagaagcgttcataaataagctcggaagcctcatacatgaagtgaacattttgaaaaagacggaggacgtaaaacatgaatcctaaaaaactgactgacattgaacatacaacattaaaaagccagctggaagaaggcaaggttcgggtgattatagtagacggactgaagaaggaagcatggctcgccgaagcgccggagcacggcaaaacgcttgtcgaaacacgaaaaggggatctggcccgggtcgaatatgaaatcggctttaaattgaattaatcgaaaaaaacagaatacgtccaagacggaaagcctgcggacactgatcaatcgcgcacatgctgcgcattggttggtgtcctttttttgttccgaaaaagaggaggatctacatggaagacttactatttgaatataaacgcacgctgaaagagacgaaaaagtggtacaagcagctggaggcagccgatgaaacggtgcttacttcagaagaactgaaagataaaaaaatcatcagaacgattattacagatttggagtatgtcatcgaatggcttgaaaaaggccggcagcccggcataagaagagcgatagaccgcagagacgcttatcagagaatgctcattaaagatccgagaatcatagaaacctattcgcaggcgctgatgtttgaaccgtccgcaaatgtgactgaagaagacagaatcagactgcgggacgcattagccgttttaacggatagagaaaaagaaatgctgctgctccacaaagcggaatgcttttcgtatgaacggatcgccgccttgctgaatgtaaagaaatcaaccgtacaaacgacggtcaaacgggcgcttctgaaaattcaaaaacagcaggaacaaagaaatcaatcgcctgcttcataagttgtcatacgtttgccacctagaagtgaatagtagatcacaaaaagcggcccgattagaagccgctttttattatagacaatcatgtcggaggtggcggtgatgccgtagcatgaaaaacgcaaaaagagaacaggcatttacaatctatcagtctcataaaggccgcatcacaaatcgcgcccttgccggcaaatcaggcgtatccgcaagaacgatcggcagatggaaaaaagaagggcgctgggacgaggcgcttaataagaacgcggaaagcggcggaaaaaacaccccgggcgaaggtgatgagttaaacgaacgccagcggctgttttgtctttattatgtgaaaagctttaacgccacccaatctgcgataaaagccgggtattcaccggaaagcgcgcatgtgacgggaagcaggctgttaaaaaacgaaaaagtcgctaaagaaatcagccgcatgaaaaaggaaatggtcaataaagtgtttgtcgaagcgatggacgttcttcaagtctatgtgaaaatcgctttcgccgacattaccgattatgtaaccttcggaaaaaaagaggttcaggccttcggaaaatcagggccgctctttgacgaaaatgataatccgattatgcaggagatcagctacgttgacgttaaagattcgcaccttctggacggaaccatcgtcacggaagcaaaactcgggaaagaaggcattgcaataaagcttgccgacaagatgaaggctcttgaaaagctgtccttgtactttgaccttttccccgatcaatttaaacaaaaaatcgaaaatgaaaaattaaagctggctcagcagaagatggaaaaaacagaagacagccaaaagccgattgacattgtcattacgcggaaagaggaacggtcatgattgaaaaagcggtcaacccgcgctttgaagattatttgttcaattggaatgaaacgtaccaatttctcgttggaggctacggctcgtcaaaaagctatcataccgcgctgaaaatcatcctgaagctgcttcgtgaaaagcggacggcccttgtcgtgcgggaagtattcgatacgcacagggattctacgtttgccttgtttgaagacattatcggggagcttgagctgggacatgccgtaaaggccgtttcttcgccgatgcagctgagattttcaaacggaagccggattatgtttaaagggatggacaacccggccaaattgaaatccattcatcatatttcactgatttggattgaagaatgctctgaagtgaagtatgaaggctttaaggagctgatcggccgtctgcgtcatcccgagctttcgctgcatatgatatgcaccacaaatcccgtcggcacctccaattggacgtaccggcatttttttcgtgatgaccaaaaaaaacggttcgtattggatgatcagacgctgtatgaaaaaggcaccgtcgttaagggagatacgtattaccaccattccacagcgtgcgataatctgtttttgccgaaaagctatattaagcagctggacagcttacggcattacgatcctgatttgtaccggatcgcccgcaaaggacagttcggcgtcaacggcatccgcgtgtttccgcagtttcaggtcatggagcacaacgaagtaacggagcggattgcttccatcaggcgccccctgtttcggacgggcatggatttcggttttgaagagtcatacaatgcggtcattcggcttgccgtcgatccggatcaaaaagatctttatattttctgggagtattacaaaaacaaaatgaccgatgatcagacagctgaggagcttcaggaattggcggatcaaaaagagctgatcaaagcggattcggctgagccgaaaagcatccaatatttccgcaggcagggattttgcatggtcgcggccaaaaagtttccgggctcaagacttcagtatacaaaaaagctgaaacggttcagacacatctattgctcagacagctgtgaaaatacgatccgcgaattgcagaacttaacgtacgcaaaaaacaaaaacggcgctctgtcggaagatgagttttcgattgatccccacacactttcagccatttggtatgcgctggatgactatgacgcggcggatctgaaagatgcatcacaaaaacggagacgtccgaatcgggaaaggaggagataggcgttgccgaactatcaaaacgttagagccaccgtctttaaatcaaaaatggccgcgccgcaggcaaggcagatgaacgaagatcaatttgccgatctgtacggcgaagacatcatttcaccgccctataatctcattgaactgaaaacaatcgccgaatactcgacgattcttcagcagtgcattgacgcgtatcgggtcaatattacgggttttgggttcgatgtggaatatacctttgatgtaaatagcccagattgctccccgtcaaaaaaggcccgggccgaaaaaaactggatgaagctggagagcttttacaaatgtcttcattttgatgaatcggccgagacggtcctcggatatgcgatagaagaccgcgaaaaaacgggcaacggtttcctcgaagtgcttcgggacggcgcgggaaaaccggcggggattgaatatctggatgtaaaacatatgcgcgtctgcggtgtgactgatcccgttgaagttacattttcatatgaagaaaacggcgcatccaaaacgattaaaaggcaaaaacggttccgtaaatatgttcagatgctgaacggtcggaaagtgttttttaaggaatacggcgatccccgcatgatggacatgagaaccggcgaatacgtaaagaccctgtctgaagaataccgggcaaatgaagccattcacttaaaaatcggcagcggcacttacggcattccgcgctgggtcggcaatatcgtcaatctgtacggcgcccggaaagcggaagaactgaattttatgtatttcaagcagggccgtcatgtgccggccgccattacggttgaaaacggcatgctgtcagaaacctcgtacaaagagcttcaggattatatgaatgacctggaaggggtggaaaacgcccacaaatttctgctgattgaggcggaaggcattgcgaaggaaaaagaccttcacggaggcgaagacattacgcccgtgtctgttgaaattaaatcacttgcggaaattctgcaggatgatgcgctgtttcttgaatatgacgacaaaagcagaaataaactccgttccgctttccgtctcccgccgctttatacgggagaggcgcaggaatacaacaaagccacagccgatacggcacggaaaatcacggaggagcaggtgtttcagccggagcggaaaacgctgattaataagctcaacacgttatttttgcctgaactgggtctccacgatgtacagctcacattaaaagggcctgattttcgcgatccgcttgaaattgcgaaggtgcttacgccatttatttccgccggcgcggtctctcctaatgacctccgtgatctggcgggaagagtgctcggcaagacgcttgaggaatggcctgaagagtactacagccggccggtgctgaaagggaaataggagcaatcctgaaagggggtgaaaacatctcgtgccgagagaattgagaaatgccgtcatcagttttgtgagctatgtcgataaggcggcgaaccaaacggaattcttttttacaaaatcagccggaggccttccgtcatttgaaaaaaaggtgcaggtgtttacaaaaaacgaatcggatgagcagaagcttgtttacggcatcgtttacgagccggatgtccccgatgcacatggcgattatatgacggctgaagagattgaaaaggccgctcacggttttttggcggacgcccgcaacatcgatacaaatcataactttgaaggcgggaccggcgaggtggtggagtcgtacgtcgccccggatgactttgaaatcgggaatgctgtgatccggaaaggatcttgggtgcttgtcaccaaagcttccgatgaagtatgggatcagattaaagccggtatcattacgggctacagcatggcgggaaccgctgacgtttacgaagagccggcagaaaagcaagccggcttattcggcgcggtcaagcaatttctcgaccgtgaccgcaaatcaagaaaccgcaagggagaggacttgaacaagatgagaaaagaagacgtaagagaatcgattgaacacgcgctgcacccgcttttaaagcggcttgacagtttggaccagaacacggaagacaaagacggggcggctgcgccgtctgatgaagaaaagctgaaaacgcttgttgaggacatgctggcgccgattattaaacgcattgaagcgcttgaaaaagtaagaggcgcatcaaagcagccggaagaagagacgggcggccaagagcctgttaaaaaatccatttggagcggactgctttaagcccagtcagaaggaggaactgtagagtgagaaatcaagatatcatcagaaaggcggaaatgtcactttccgctttaaaaagcggcggtttaatgaaccccgcacaagcttcagcatttatccgcatggtgcagaacacgccgaccattttcagcgaatcgcgtgtgattcaaatggaaaatgactcgcagaaatttgaaaaaatcggtttcggccagcgtattctgcgtgccgctgaggaaggaaaagctttaactgacgatcagctgaccgtcccgtcaacaagtacggtgcagctgaatacgaaagaagtcattgcggaaattaatatcacctatgacacgcttgaaaacaatattgaaaaagacggcctgcagcagacgatcatgcagattttggcggagcgggcggcagtcgatattgaggagcttgtcgtaaacggcgatacatcttcttctgatccgtacttggcacagcttgacggaatccgaaagcagactgtatctcacgtcattgacggaaacggggaagagctgtccagagccacatttaaaaaaggcttaaaagccattccggcaaaatatttgcgactgcctcaggaattcagattttacacatctcaaggcatggagattgaatggaaagaccgtgtggctgaccgtcagaccaatctgggagatcttgcggtgcagggcggtttgtcttcagcattcggcgttccggtcaaaggagtgtccaatctgcagccgtactcagtcggagaaggtgattcccagtacgatgcgtctgacatcattttgactcacccgaaaaatatcattctcggtttttcaagaaatatccgaatcgaagtagataaagatattcgcagccgcaaatttattatcgtactgacggctaaacttgacagcaaatttgaagaagaagatgcaagcgccaaaatcgtaaacgttaaagaataagacgggggtggcagttatgttaattcagccgtctgacgttgtttcatattcagtttatgatcaagtcaaaaacaggccggaggcgcttcttatacaggacattctggaggcggaggcggaagcggccagaatagcggggcattcgttcactgaccctgtttactcaccgcttcccgaaaagattaagcttgcgttattaaagctttctcaatattttgcgctgatcaaccagaatgaagcagccgcttccgcctatcaatctgaaaagataggcgactactcgtatacggtggcaggtgaaggcggaatcagaaaaccggcggtgcaccatctgctctgtgaatatatcgcgccgggttattccccggtttctgcacacgcaaaggtgaggcctttatgagctacgaacggctgctcactgacagatgcgatatttatcatgagacggtgtcagttccgaaggccggacgcttcgggattcccgccgaaaagctccagcctgtcttttcttatccggaagtgcccgattatgaagacgtgccgtgtctgtttgttgaaaaacagcagcagcttattcagcttgagcctgatcataaggtatatcagcggtttctcgttcattttccgaaagaggccgttgtgcgtgtcaatgacaaaatcatttgggaaggccaggcgtatattctggaaatgccgaagaaagcaagacagcaccattgggaggttatcgctgtgagagatgacagactatgaacataaaaaaccttgaacaatggaatcggtcgctgcaaaaggcatcatctggagaatttgcccgtcaggcaggcgaatggctggaacagtcaggagaggattttctcgacttggtacgggaggagcttattcattcgggagggattgatacagaaagcctgctgtcttctttccgaaaaggagcgcaggatcatgtatggatcattgaaaacgggggactgacccttgaaatcggcaccaatgtagagtatgcctcattcataaatgacggacattggaccgtctcagatgaaaatgtcagatgggtgcccgggtattttcaaggctcccggttcatctatgatccgtcagcttcaacgggaatggcgctcaaaaaacagtggatcagcggaaatgggttttgggacaaagcccttcttttgtatgaaacactcttcgccgaatcgctggataagcgtttcaatcagtggcttaacacgttggggggagatatcggatgaatcgcgaaaccggttcaatcgccgcttttttgtatcagcaatgcggcgtgcccgtatatgaaaatgaactgcctgaacaatttcaggtgccgtcactttacatcccgcccccgtacgcttttgacgagaatgacacagtctccacctttaagaagacatacagtctgaatgtgaagctgttccatgccgactcggtgcaggcgctctatgcagccgaccggatcgccgatgcggtgagagaatcaagacagctgatcccgctgcttacggaatcaggggaggataccggtgatttcgtccgcatcagccgtatcgaaacaagagtcggagacaaaggcgaggcagtgatcaccatccgctggacgagccgctactactatcagaaacaaacatctcccgcactgcgggatgtggacattaacagcggggtgaaacaaaagtgaaacaatataaaaagaaaaacgccgcaactgcggaacgagcggttctttatgacacggcggatttaacaaagcacgcgaaggagcttttcggcgtaaaacccgagattctccagggggctttattcggcgtgaagcaaaaacaaatgacaaaagcgcaagccaagtcttacattgaagcatttttaaccaaggaggtcatgcaataatgaatggcggaacatttacgcaaggaaaagaaaaagaacgtgccggaatctattttaactttaaaacaaccgcccaggagcgggtatcgatcggtgaacgcgggattgtcgcccttcccgtcgcatccggctggggggaagcgaaaacattcgtttccatttcaagcgttgaagatttgaataaaaaagtggggctcagtattgaagatccgtcactgattctgcttcgtgaggcgaaaaagaaagcaaaaaccgttttgatgtaccgtctgacagagggaatcagagcgagcgcagatctttcgcaaggtgttaaagcaaccgctttgtacgggggttcaaaaggaaatgacatcatcatccgcatcagtgaaaatgtccttgatcagaccgctttcgatgtgaccacttacatggatgaagcggaagttgacaaacaaacggtgaaaaaagccgaagaattaaaagcaaacggctatgtcacatttacgggaacgggcgaactgtcggcttccatcccgctgacaggcactgaggaagaatccggggaaacgttaaacccgcaggcaggcatccgtctcgcgggaggaactgataaagcaccggtcaactcagactatacggattttttagctgcggctgaaacggagaatttcgatgtcattgctcttcctgtcgcggaaaacgatcagctgaaagcgacatttgccgcattcattaaacgccttcgcgatgcacagggacagaaagtgcaaggggtgactgcccattacagcggagattatgaaggcattatcaatgtgactgaaggtgtgctgctggaagacggaactgagattaaagctgaagatgcgaccgcctgggtggcaggcgcaagtgccagcgccgcatttaatcaatccttaacattcgttgaatacgaaggcgccgtcgatgtgctgcaccgcctgactcatgatgaagtgatcgaacgtctttccaaaggtgaattccttttctcttatgatgcccgtgataagtcagtcagcgttgaaaaagatatcaactcattggtgacatttacggcagagaaaaacaaaaagttcgcgaaaaacaaaatcgtccgtgtgcttgatgcggtgaataacgatttgacacgtgaactgaaagccttaattaaatcgaaaaaaggcaccggaagcgatcttccagcgacaaatgacggccttcaattcgtcaaaacgatgattattcaatatttgacaacgcttcaggatgcgggcggcatcgctaactttgattcagacaaagacattacaatcggccttaatgaagaccgcgacggctttttaatcgatctcgccgtgcagcctgtggatgcggcagaaaaattctactttaatgtggaggtaaactaagatggcattaaaagcgcaaaacacaatttcaggaaaagaaggccgtttatttctcgacggagaagagatggcgcatattaaaacgtttgaagcaaacgtggaaaaaaacaaatcagaagtaaacatcatgggccgccgcatgacgggacataaaacaacaggcgccaacggaacgggcacggcaacattctataaggtcacatccaaattcgctgtgcttatgatggattacgtgaaaaaaggcagcgacccgtattttacgctgcaagccgttcttgacgacaaatcatcaggccgcggaacagaacgcgtcaccctgtatgacgtcaactttgattctgcaaaaatcgccggactggacgtagactcagaagcgctcgaagaagaagtgccgtttacctttgaagatttcgatgtgccggaaaagctttctgaaacgttttaatcaggatcattatgagtgaaacaggcctttaacaggcctgttttttataaaaaaaagagtaagggagttttcatcatgagcgaaaaaaacgaacaagtatttgatctgtcattctttatgccgggtaaaacagtcgaggctgaggagattcgggttccgctttcaaagcgttttgtcgataaaaaaggaaacatcgtgccttttatttttaaagccattacgactgagcgcattgacgaactggagaaggaaagcacgacatataaaaatgtgaagggcagaggccgcgtaaaagacttagacagccagcgcttctatgcgcggatcgcggttgaatctacgatttaccctgatttccggtctaaggagctccgcgacgcttacaaaacggcagatccggtcgaggtggcaaaacgcgttctttcagtcggcggtgagtatgcaaattggctgaataaagcgattgagatcaacggttttgaagatgaattagaagatctggagcaagaagcaaaaaactgataaaagatgggaataaggaagccgtgtatctctattacgcgatgcatgagcttcattattctccatcagaactgaaagagttatatgaagcaccgagacattttaaggcgctgttgtacggtttaatcggttacaagctggacattcttgaaaaacaagcgaagaaagggggagcgacatcatggcaaagctgaccgctcgttttgaattggaagatcgggtttcaaagaaaataaggaaaatccaaaatggcttcagagcgcttgagaaatacaggaaaatgacaaaacgccaaagtgaaattgatatacgcaaagagagtaaatctgtcttaagaacaattgaccgcatccagcgctctatgaaaagaaagctgggcgcacaaacgatctctatttcagctgaagacggagccagtgccgtcattcaaaaggtgcaagcccaattagcgggtctgcctgcgtctttaaccgttaaaataggagcaaaagacagcgcgacagcggcatttgagagattgcgggatctggctgccggttttaaaggatttaccgtttcactgtatgcgtcagacgaagtgactcctgccatggaacgtatcaaacgctacatgcaatctgcgttaaagaacgggtactctgtcactatacgcgtcatagatcacgtcatgaaaacagtcggccgaatttcagcggggattgattcgctgacggggaaaaacaatgtcattcaattatcgttaaacgaaacggtgacagcacagctggctgcaatgcaaaagaatatgccggacgtcggaaaagcttctgcatctgctgctcctgcttcgccgaaaaatgatttttcaatgcttgactccattgcagacatcttcatgaaaaaagtcaatgacatcgcatccaaattttatccggaaacaatcatagcggaactggataaattcgctgcaagctttatgaagaaagcggacgaaatcgcaagcaaattcagtccggcaacgattttagctgaactggataagttcacgacctcattcatggggaaagtggacgaaatcgcaagcaaattcagcccggagacgattttagccgaactggacaagttcacgacctcatttatgggaaaagtagatgaaatcgcaagcaaattcagcccggcaacgatattagcagagctggacaagttcacgacctcatttatgggaaaagtagatgaaatcgcaagcaaattcagcccggagacgattttagccgaactggacaagttcacaacctcattcatgggaaaagtagatgaaatcgcaagcaaattcagcccggcaacgatattagccgagctggacaagttcacgacctcattcatggggaaagtggatgaaatcgcaagcaaattcagcccggcaacgatattagtcgagctggacaagttcacgacctcattcatggggaaagcggacgaaatcgcaagcaagttcagcccggcaacgatattagccgaactggacaagttcacgacctcattcatggggaaagcggacgaaattgcaagcaaattcagcccggcaacgatattagccgaactggacaagttcacgacctcattcatggggaaagtggatgaaatcgcaagcaaattcagcccggcaacgatattagcagagctggacaaattcgctgattcgtttatgaaaaaggtagacggagtcgtgagtaaattcagtccggaagccatattgaaagaactggataaattcactgattcatttatgaaaaaggttgatgacgttgtcagcaaattcagtccggagaccatattgaaagagctggatcattttactgattcgtttatgaagaaagtcgacgacgttatcggtaaattcagtcctgataagctaatcgaccgtgctgaacaatttgtaaatgacacgattgaccgaatttctgagaaattcgattttctcaatccggataagattttggaaaaagtggagcagtttacttcctcactgttcggaggcattgataaaaagttcggcaaattcagtcctgatgcgatcatcgaaaaagctgaggcatttgttgataaaattgtcagcaagattgccaagaaatttgagaaattcagcccggacaaaatcatcgaaaaagccggggaattaatagaaaaaatattttcaggaatcgctgaaaaattaggcaaactcaatgtcggcggattattaggaggcggcacgaaaaaagaaaagagtaaggggagcctttctgccggcggcaccaacagcccgaagcgtcctgatctgacaaagggtccgcagcgcacgggaccatcaccgaaatcttcaggaaggtcagccaaaaaaacaggcggggctttggggggctgctgctgtaccggagtgacgaggggcaaaagcagtaaagtcgaagggcggaataaatcttcgaaaagaggttcctccgtaaaggaaagcaaacaggcatccgtaaacacgccgaaaacaaaaggggcaggtaaaggcatcggcgggcttttgaaaggcttaggagattcaaaggcgctgaaaggcggtatgaaagggttaaaaggtgccgctaaaggaattcccggcataggtgaattgttatcacttactgatttagccggcatcaataaagataatgcaggagagaaggtcggctcagcaggcggcggtcttgcaggagccgcggccggagcggcaatcggcagcgttgttcccggagtgggcacattaatcggcggcgcggtaggcggcatcgccggcagtttaggcggttccagcttgggagaggcctttgattcaggggctttgaaagacacatggaatgatatttccgaagcggcgcaaagtgcttggacaacaatacaagatacttggggaagcgtttcatcctggttcatggaaaatgtatggacgccggtttcatcagctgtcgccggagtggcgacaagcatttggtcaaatatcgtgaatgcgtggacgacgattcaagggattttcagcacggtgtcatcctggttcatggagaatgtatggacgccggtttcaacggctgtcgtcggagtggcgacaagcatctggtcaaatatcgtgaatgcatggacgacgattcaaggtgtcttcagcacagtatccggctggtttatgagcactgtctgggagcccgtaaaatcggctgtcgtcggagtagcgacgtccatttggagtaaaatcacaggagcttgggataaaattaaatctgttttcagtacggtatccggctggttcatggatattgtctggaacccggtgaaaaacatggtggaaaaagtcggaaaaggaatatcagacgctttcacgactgctttagatacggtaaaggatatatggaaagggttaagcggctggtttgagaaacatataaaagaacctcttgtcaaagtgggaacagccatatcagatgctttttctgcagcattcgactgggtgaaaaagatttgggataaaaccggcggcaaattgatttcaggcgtaatggacttcgtcacaggcggcggagataaaaagaaaaaaccggacaaaaacgccacgggcggctacattacaaagccgaccatttcctggatcggtgaagccggtaaagaatttgtcatccccgtcgacaacaatcgcggacgcggaaagatgctgctttcacaagctgcgtctaagctcggcatgcgtgttgtcgatgatatgggtgcggcttcggctcagtcttccgctgtgccggcgggagcgggcggtgtttcttcttctgcatctgtatcggccgcagcgtctgtagaggcatccggacttggcgggacggcttcatcactcggcaaacagtttactgaaggctttgacagcggaatcagcaataaatcggtggatatggacggctggaaggagaaaaacatcggaacgccgttcaatgccctcatttcgtcttcacccggttacggaaagcaagtcgttgcgggctatgccaaaggtcagaatacatcgccgacgggcaccgattcatttttaaaaacaaaggtgaaagcaccttatcaatcggcggttaatcaatcgtcatcatggggcgccgccacagtgaaaggatattcggccggacagaatgcaaaagatacgggaacgtcgcaatacgtaagcacacatatcaataaaccgtttgttcaatcaagagattccgcgaacggctggggatcaggcctgatcggacacttcgtatcaggaatgactgcaaaaggaagcgaagtcaaacaggcggccaaagatatggccaaaaaagtcgaggacgcattcagggaagagcttgatattcactctccttcccgtgtcatgatgagtctcggacgctttgcttcagtcggcgtcgtcaaaggcctcagctcagttgacgtgaaaaaatacgccgaaaaacaggcaggctcgcttgcagcagccttttccggcatgggtgcagcgggaggaagcgtcaaagaatggcttttggccgcaatgaaagcaaccaatacgccgatcagctggcttccgggattaatgacgatcgcacagcatgagtcaggcggcaaccctaattccattaatctatgggacagcaacgccaaagccggacacccgtcacaggggcttatgcagacgattccgagcacctttgaagatcacaaagcgccgggcatgaatgatatcagaaatccaatccacaacgccgctgccgctatcggctatattaaaagccgatacggctcgatcagcaatgtccccgggattaaaagtatggctcatggcggcccgtacgtcggttatgccaatgggggtctgattaccaaggagcagatcgcccgtgtcggcgaagggaacaaacgggagtggatcatccctgaagagcggggcatccgcggccgttatctgctgcaaaaagcggctcaggcgctcggcatggaagtgtccgatccgtcccagacggaaccggcggcgctttcagccggcacggtatccgcagccgttaaaggcggcggacaaaccgttcaaaaaacgggaacaaaagaaattaaaatcgaattcagcggcgatcagcatttccataacggacaggacgccgacagcctcgccgccaaaatcaaacaggcgctgattgatgaactgcaaaaagacatttataccggagcaaagggggccgttgcttttgactaaatctgtttacgaattttggctgtctcaggggaaggacaagctccggcttcccgttctccctgaagcgattgatatcgcaaacagcgtgcagaatgattccgtgaaagtcaccggacttggagaggtgacgtttatcgaagaaccgggagcgaaagaaatttcgttctcttctttttttccgaaacggtacagcccgattgtcgaatatcaaagcattccttcaccggaaaaagccatttcagccattgaagcatggatgaaagcgaaaaaacccgttcagtttttgattacagggacaaaaatcaatgtcacatgcagtattgaaagctttaattacagcgaaggtgacaatgcaatcggcgaccggaattttgatatcgtactgaaagaatataaaaccgcttcgccaagaaaaatcaaacaaaagaaaaaaacgaaagcgaagcgcccgtccaaagcttcacccaaaacatataccgtcaaaaaaggggatacgctttgggacatcgccggcaagttttacggaaaacacacggagtggcggaaaatctggaacgcgaataaaaccgccatgattaaacgcagcaaacggaatatccggcagccggggcattggatcttcccggggcagaagctgaagataccgcaatgaaacgggtgaaaagatgattgaactatttgtcataaaagaaacggagtggcttgagcttgtcacagaaagcgtaacgctggaaggacacagatatcaggcgccccgctccatcgaagcgacgattgtcgtaaagcagggcagccagacgtattacggcgtatcagaaggggatacggttttgttcaaatggaacggaaaagagctgttccgcggtattgtttttgcaagaacgcccgatgagcataccgtcgccttcaccgcatacgatatgctccaataccttgtgaaaaaccaggacgtttacgtgttttccaacaagcgcgctgatcaaatattaaaaaggatcgccagcgattttcaaattcccgtcacatccattgccaacacaggccataccattaaatcactcgtttttaaaaatgatacaagcctttacgatatgatgataaaagcgttaaagcagacaaaaagccagacggggcgcaattatcagctctattcagaaaaaggcaggctcggcttgcgtgaatggccggagccgtctgacatatgggtgctggaaacaggagttaatattacagggtatcaatacagcacctctattgatgacaccgcaacccgtgttgtcatgcggctgcaaaaagacaataaaacgataaaggcttccgcctcagacagcgccggcatgaaaacattcggcgttttgcagtataccgaaacggtttctgacgacattaacgaagcccagctgaaacagcgcgcaaaagtgaagcaggctgagaaaaaaggcattaagaaagagctgaaaaatatacaggcgatcggtattcctgggttggaaagcggattgcccgtctatatttcaattccggaaatcgggctgaagaaaacctattatgtagatacggaccgccatgaattccaaggaacaaaacataccatgacgattgatgtcacggagaaaaattcacttccggaggggacatcctgatgagattaagtgatgccattaaacatttagccgtcggagcggttgacgccgaagcgccggtggagctgatcccggccgaagtgacctccgtttcgccgctcgagctgaaactgaaagatcacgacaaacttttgattccgtctgatgcactcattgtgccgaagcggctgagatccgggggagaggatcagctccaggcgggagatcgggtgatgaccgccgctttaacaggaggacagtctttctttgtactggacaaaatttaaccggcatccggacggagatatacgagaatatcagcctattaaagccgctttatctgccgaagagggcttttttacatgaacaaatctaaaaggagcgggtgcaatggccctgacaccggaaatcgaatttgaagatttggaggatgcgagtgaggccgttgagacttcacaaacctaccgaattgattttgaaaacaaccggattaccaatgaactgataaacggactggacgcaatcagacaattcgtctatatcgctcttcacacagaacggtattcatattcggttttcagccatgatatcggaaacgaacttcaggaagtgctttcagatcagaacacgacggatgcttataaaaaaatggagattccaagactgatagaagaagccttgctgtatgatgaccggattttggccgttaccaattttgagattgagaaaaaagatgatgccttcatcgtctcttttaccgttgaaactgatgagggcatgcttgagatagaggaggtgctgggtgaggatgtttgaagctcagacgtttgacgacattatggacagaatgctggcgcgcgttacggcggacattgatacgagagaaggcagcgtcatttacaatgcgctcgcgcctgcggccgctgagctcgcaaagtcttatatttggctggataccgtgctggagctcgtgttttccgatacggctcagggagaatttctggacaggcgtgctgctgaagcgggaattgaacgaacacctgccacaaaagcggtcagagccggagaattcacagcgggcatcaccattccgccaggctcccgtttcttcgttgataacctgtattttcaatatacgggggatggaacgcttgaatgtgaaacagccggtgaagcgggcaatgccggcatttcagggcaaaacctgctgccgcttgatacgatacccgggcttgagaaagcagtcgtgcgcgatatattgattcccggccgtgaggaagaagacgacaacagcttaagggcgcgctattttacccgtgtccgccgggaagcagtcagcgcaaataaacagcattataaacaatgggccgaagaggttgacggcgtcggcagggcgaaaatcttcccgctttggaacggagacggaacggtgaaagttgtcatcacaaatgcgaatttggaaccggcatcagatattctgatcaaaaaagtaaaggattatattgatccggacgaagggcagggagaaggacaggcgccgatcggagcggcagtaacggtggaaagcgccgtatggaaagaaatcgaaatctccgcttccgtgctgcctgagctgaacagctcgatcgatgacgtaaaagcggagattgaaaaaggcgtcctgaatttatttaagaaaatggccttcgaagaaaacaccgtccgtttatcacaaattaacaacatcgtttataactcggcatccgtcagtgactacgccgatatcaaaatgaacggtgcggcggaaaacctcgtgctcagtgacgtggaaattccgaaactcaaagaggtgagaatccttgagcagactcgatgagatgacggcgtacctcccgccgtttttaacccgattaaaagagatggcacaactgcttgaggcggaagctcctgagtttgagcggcagaataacgatattttcgatttgaccgatcagctctttatcacgacggcgacatgggggcttgaccgctgggaaaaaatattaaaaataccgcgggaatcaggtgacacggaggatatgagacggctcaggctgatttcgaagatgtcgaatattccgcccatcacccatcaagcgatcgagcaggcgctaaaccgttttttaaaacatccgtcagcttatgttcggatgttcccggggcagtatcgtttttatgccgatatcgggcttgatgacctgcagcacatgaacgagctgattgaaacgcttgaaaaaatcaaacccgctcatttggcgtatacactgagagccgcattaaacgaaacactggaaatcaaagaccgggtcattctcaacaatcggagataccgaaaagtcagtgaactgaaggtcggttattccgtcacactcaacaataacgaggtggtcttaccatgatatcagccgcttacagacagcgtgccgcagccgatctgaaaaacaggatcacaaaagtgctgttaaacggcaaagaaactccgattgcggacatttccgtaaaagatgccgcagtcaccgttctcacacgcagagaagaagacgtcaaacacattgaaaccgtgcagatgcttgacgaaacaggaagcgtcattacagaacgaaaaacaaatttagatctcagcaataacagaacgcttgatttaagatttacctttgaggtggtgtaacgatggcttacgaagaaaaaacagactggcttccggacgatccgattaatgaagatgatgtcaaccgctgggaaaaaggcataaaagacgcccacacggatctggcggcccataaaaacgacatgaacaacccgcacaaaacgacaaaggcgcaaatcggcctcggaaacgtggacaacgtccagcaggcagcaaaaaaagatttcgaccagcacaatcaagatctggaccggcatgtgacgaaagaagagcgccagaagtggaataacgggcaattaacaaagctgacggatgattcagggaaatatttaataagtatacaagatggcttggattttcatcaaattgtagaccagcttaatcaatcttttttcttttacacaaataacacgggagttcatactcctccgctttccaccagaggcttatatatcggattcaagtcttatggtgaggctctggcaatggattatgaaggaggcacatggagaaaaacccttaaagcttccggctggaccgattgggttcagttagaaacttcggaaggcgcccaaaaaaaagtcgatgcccacacaaatcagactgatatccatgtaacgaaagctgagaaggatacatggaatgcagggcagctgtttaaaatcaccgctgataacggcacgcaaaaaatcaatttaacttccggctcgttttatgactcgttaaaagatgttggttctgtaactttttacggaaccaatgcagtaacagacaacccgtcaaatacgagtctgcgcggtatgcagttagtggggcagccgggaataggtaatggttatgctgtagacgtgaagggtaatgcatggtggttttattataactctaatcaaacagcaatcaattggtatccaattgaatccatagctggagcgcagtcaaaggtcgatgcacatgcgatagattcatcaattcatataagccctatcgaaagagacaaatggaacggcggccagttggcgaagttgacaaaggatgatgggagacggacacgattagaaaacggatcagacatactggcgctgagctcggggttttattgtggaatgggtgctcagcttaaaaacaatccggttgaaaatgataattcctggtttaactatgatgtggttgagggggagtcagggaggaagtcgattttagcttggagaagttacgataacaatgtatggattgcaactgttcatacagacggtgtttttaaggggtggaaacgtctatttactgaagaagattttaataaaataacttggtatgatttaacgctaattaatggacataaggttggcggaagaaaacctcagtatgcagtgtggggcaaccaagtattcacccgtggtgaagtggttcctccagacttcgatagtgtttttgctgtactccctgctgaagctcatccttcaacacagaaagcaatggctgccactttctttggaacaacgggggtaacaaaatattatgccgaaccaacgggtgaactgagatttagcggaaaattcgctaaaatagaggaaaatattacagggatttcaatagataataatttcactttgtaatgagggatgaatatgcaagtctttttgtatgatgagagtttttattttcaaaggcctgaaatcttagacagtatatcaagtacaatgccgcaaaactcaacaaccataaaacctccggacggcttatggagaccgcagtttgatgaagtaaataaaatttggaacgaatctgctgatcaagaatataaggaaaatcaaaaaaacaagtatcaggatgtggtggagccggatcccattgtggaacagttgaaagaaatcggacagcaactggcagatgaaaaactagcgagaaaacaagcagaacaagctcaaaatgctttaggtgtacaattgtctgccgaagtggtagcaagggagaaaacagagatgttgaataaagctttaggtgaaaaattagcgtctttaaaactggaactcttacacgtaaaaggagaatgaaaaaatgaaaaagcttaacttttgggtttacgccttgttttatgagtgggcctcaacagaaatggtaaaacaggctatgggctatgatgactgctctgccgaagatctggctgaaggtgtggccgcgaagtatgtcacacctgaggaatttcaagaaataacgggtgaaacatacgaagactataaaaatgctgtgtcataagccagacggctttttttatttgtcatttttaataaatgagaaaaggaggacggccgatgaaaaagcatccatttgaatttcccgccgatcaacttggcaggcccggcgctgtaaaagcttatcgcggtaacaaaaacgattatgtcacaccggttgctgatttgtccggaatggcagagcttcttaccaatacgccgctagaagcgattgaagtttacagtcaattcggacaagaccgtttaggagccgtcttaataaacagagcacaggggtgggcttattcggaccgcagcggaactctttttatcgaagagagcgaggataacaattcgtggacagcttcacattctgtcgcagtaaaaggcggagtgctgaccgcttcggggtgggtctgcctgacaaaaagatattaccggttccgttttgaaaatggaaatcaaaaacagtccgaatttgttttataccaatctgtcggttcgggcggtgatatggcgttttcatatactgacgtgatttttcatgaaaatgcagcagaggcgggcgtgggaagcatcttctcagcgggcgcttggaaaaaacttctcgtcgaaatcaccggcacggctgagtcgggccatgtcgcgttttgggggagatccatctcgggaaaaaatgtgccgatcagaggaatcaggtctgatgacgggacatcagccgccggtacgtcaggcacagaagaagtgtggtcgtttgatattgccggctttaaggaaatcgtcatggaaatcaagagcatttccggcgggagcctttctgtcaaaggcacggcattttcttaagaatgaagcttccgaagggaggtgagaacaatgtaagaggggggagcggaagtgcttctggatgaacaagcggtgcaaaaagaattcgcaggcatcaaaggtgaacaaaaggtgcttgaacagcgggtagccgcattagagcgggtatcagaccggcaggatcagcaaatcatgacgctgaatgaaaaactgaacaaaattgacgaaaacacaacatggattaagcggaccattacaggagcgatcgtgacagcaatctgcacgggcgtcattggcggagccatcgccatcatgtacaatctgctgcaaaagtaagggggaaaccgatatgaaattcgcggacaaaggcacggtcgtcaggacggtgcttcttttgcttgctttattgaatcaaactttgctgatgttcggcaaatcgccgctgaatattcaggaggaccaggtcagccagcttgcagatacgctgtatgccgccgggtcggccgtttttacaatcataacgactgccgccgcctggtttaaaaacaattatgttacagcaaaagggaaaaaacagcaggctttattaaaaataaacaatttatcgaaataggagagatgagaatatggtaaaaatcacacaggattttatcccggcaggaaacaataaccgcccaggctatgcaatgacaccgatttacattacggtgcacaatacagccaataccgcagtcggagctaacgccaaaagtcacgcaagctatgtgaaaaatcccgatacaccgacaagctggcatttcacagtcgatgatacggaaatttatcagcatcttccgctgaacgaaaacggctggcatgccggtgacggaaacggggacggcaaccgtaaatccatcggtattgaaatttgtgaaaacgcagacggcaacttttcacaggccgtggcaaacgcccaatggctcatccgcacattaatgacgtcgcacggcatcccgcttgcgaatgtcgttgcgcacaagcattggtcaggaaagctttgtccgagaagactgctggatacatgggatgagtttaaagcgggaatcggttctgaggaaagacagacgtataccgtccaaaaaggagatacgctgtcggcgatcgcgcggaaattcggcgtcagcgtggccgatctgcagaaatggaataacatcgctgacccgaacctgattaaagtcggacaagtgctgatcgtcagcccgccggttgaagcactgtattctcttccggacgaggtgatcaagctgacagagccgtacacgtccggtgaaaaggtataccaggtgcaaaacgcgctcgcagcgctttatttctatcctgaaaaaggagctgtcaataacggcattgacggtatctacggtccgaaaacggcagatgccgtggcccgcttccaatctgtaaacggactgacgtctgacggcgtctacggtcccgctgtaaaagcgaaaattctgatgcagctttaacaaaaaaggctgagtcccgttcacattgcgggattcagccttttttctttttcaaccggttcaatagcccgagattcctcgcccgcatcctcagcgaataagcggaaagcccgaagcgtccgtaatccacaaactttacacgcctgacaattttcttcacatcatcacctgtcgcatctctttgttggttttattatatgaaagataaggaaaaaaggaataaggacaagagccgtgtctcctgtccttagtgtaatcaagcttttttttgtttatacttgtcaatcagccgctcgttttctttgaaaattctggcggtatgagggctgacctggtaacttgcgatacttgtcattgaacgttttttaaacattttgaacggtttcgctctttgttccggctgcccgttttgaaatgcctgctccatttaaccgtcaccttcctcttctattggcagcattaaatcataaatgctcgttagcgatgtgaaaagcaaataatcgaattccgtcaacaggttttccgacgtgagtttgatcacgtaatggcggttctggactgtaaacggaataagcacaagcctgcctttttgatcatagtagacgtctttacggttaagacgggactgaacgtccgccgcatcaggcatatgctccgtcaagcggtccttatccgattgtgcggaatagtcgcacaaggaagccgtgacattcattttttctccataagcggccagcagtctgctgatgccttccgcataagcttctgtacttccataatatacatggatcggttcatttttcaacagatattgataggttttcagtttttcaagataggagtgaagcatttcgttattttcttctaaaatttcccgcgtatccgtctctaattcattgccggcgagctttttgatatacgcgctcaaaaagataaacgcatcaataagggcaaagcagacggcaacaatcaaatattgtctccatgcggcaaagagcgattcgggatcatatgtccaatagaccatggcgcctactacaaatagtaaataccacgttttacggatggcaaacattttttcttttacctttgcctcataccgccaggatgcgtacacatataaaatgagtgcggccgccatcgtccacaccatgatctgaaaaaacaaaagcatgagcatccctcacaattcgaaaaatggtctgctatgttcattctatgtcatgacatcattttcctgtcacaaaaaaaaccgcttctgtaaagaagcggatgtcatcagaaaaagagatctaagatgaaaaaggcgatggcgccgagtgtacctgcaatcggcagggtgatgacccatgtaataagcatccgtttagccgttccccagtttacgccttttacgcggtgggaagcgcccacaccgagaatggaagacgaaatgacgtgcgtcgtgctgacagggagatgaataaacgtggccccgaaaataatggctgcgccggttaagtcggcagatacgccgtttaccggacggattttcataatttttccgccgacggttttaatgattttccagccgccgatggatgtgccgagacccattgccagggcacaagagagctgcacccaaaaaggaatggcatcacttttatgtaaattggccgtcataagcgccatcgtaatgatacccatcgctttttgcgcgtcgtttgttccgtgtgtataggactgaatggcagccgtcaaaatctgcactctgcggaagcgtttatttgttttcgccagattgctgtctttaaaaatcagcttcacgatcgaatatacgataaagccgagaacaaaggcgataatcggcgataaaataagtgcttcgataatcttaatgaaccctttataattaagcgtcgcaaaacctgacgctgcaatggccgctccggcgatcgctccgataatcgcatgtgaagagctgctcggaatgccgaaataccatgtgatcaagttccaggcgattgcggcgagtagagccgccagaatgacaactgacccgttgtctaatgtataaggattcacaatgtccttcgtaatggttttcgccacaccggtaaatgtcatcgctccgagaaagttcatgatggcggccatgacgattgcgtgccgcggcttcagcgcttttgtcgaaactgaggtggcgattgcgtttgcggtatcgtgaaatccgttaatgaagtcaaataccaaagcgcatatgacaattaatatcgttaaaagtaatagagtatccattataacccctcgttacgcgtttttcataataatggtttcaaggttattggcaacgctttggcaagagtcggcaatttcctcaagcgtttcgtaaatctcgcggtactgaatcactttaatcggatcggtttctgtgccgaacagattttttaatgatttacggtgcaggttatcacagctgtgctcgtattccttaattttaatggcgtgagggtgaatgtccttcaatcggttttctgcaagcagctcaatcgtgattaaaatttccttcgcgcactctctgatgtatccgctgaacttatcgatatgctcatctgaagaagtgatcgagaaaatctccatcattgctgaaaaatgttcgattccgtcaagcacgtcatcgaggctgtttgtcagctcaaggatgtcttcacgttcaatgggagtgataaaagctttgttcagctctttaatcatgacatgaacatgattatctccttttgtttcaaactcttttaacgtatcggcaaattcctttaaagtcgtctggttcgtcactttaaagttgacaaagtattctgcggtttcgtctatgttttttgcgatttctgttaaaaggagtgagaacttatctttttttctttttatcattaaaaaccctccattgtttgaatgagacaatgcacacatcaaattattatatagccttttgtcgaaaaaaaacagataaagtcgaaaaaaacgcctcttgattttttcgtaaaaacgtgtctcatcctgtttttcttatgttacccacttcgccaaaaaaacgtaacatacttcgaattcagacatcttgcttaaaaagtataacaaaagatgtgaatttgctgtcaacttttgcacgtgattttgccagaaaaaaaacggctcccgtaaaaggaaccgtttttgtcagttttttctgccgtttttcagccaaaaataaagcggcagcccggcgaggccgatcaagagggacagcgcgcagctcagtgtatctgtaatgatcgtgctgatcagcacaaacagtgaacccgcgatggccaaaacaggaatgatcggatacaaaggcacgctgtaggcgcgcggttttcctccgcttttttttctgaggataaacacggcgaaaaaagccatgacgtaaaaaatataaatcatgaaaatagagatttcagacagcttatcgggattgctggcgatcatgaaaataatggccagcgcgatctgaaatgacacggcaatccacggggtgcggaatgtcggatgcacccgcgaaatctgtccggcaaacggcagctgtttccgttccgccatcgcaaacgagacacgcggaaaagcgagaatctttccgtttaaacagccgaagatgctgacgatgattccgacgctgatcaattttcccccgatgtcgccaaacagcattccggcagctgtgccggtcgcattttcaccgagtttgacgatgtcggtcgcaggaagaatgtgcagcagcgcaaggttaatgaaaagataaatggcggtgacgaccaaaagtccgcccgtcatcgctctcgggagcagcttttccggatttttcatttcgccgccgagtgccgcaagcagaatccatccgtcataagcaaacaaggtggccagtatggcagcgccgaaattcatttccgacatgctgcttgtgacggctgtgaaaatatgctgatcgcctttccaaaggccgaacacgatcatgcagataatcggaatcaatttgccgacagtcgtaattccctgtacgatgccgccatatttcgttccgataatgttaatgatgcttaaaaacaaaacggctgaaatcccgatcaatttagaccagccggaatcccagctgaacagatgggccatcaaggagccgaaatacaagccgattgctccgataatggcggggccgtaaatgataatttgaacccatccgcacaaaaagccccaaaattcgccgtacacttcttcgagatatgtataaagtccgcccgttttcggaatctgagtgccgatttccgcaacggtcaagccgccggcaagcgtcaaaatgcctcctaacagccacgcgataagcgcggttttcgcatcaccggagtaggcaagcacggcgcctggtttcataaatacgccggaaccgatgatggtgccgataacaagtgagagggcgatggtaaggccgatctcttttttaagtccgttctcttcaatctgcatatcctttccctccagatgtaaaatcgtcatgctgaaaaaactattttccatattgtaaaccctaattgctgaaacacgaataaaataaattttctgattttggtgttttgcctaaaagataaaggtttatgcttttgagaaggaaaaaatactgttttaaaagcgaacgttaatggtttttttaatatcaaaagttcgttattttgagaacggcagtctgcagaccgtctgtgaagcagatgggttgactttacgatccggataacataaattgtatatataaaatatctcgaaatcgagataattgactggaggataacataatgaaagttaatggaatacaccatgtatcagcattgacggctgatgcgcagaaaaatttagatttttatcgaaatatcctggggctgaagcttgtgaaaaaatcggtaaaccaggatgaaccgacgatgtatcacttattttacggtgatgaatcagccaatccgggatcggaattgacgtttttcgagattcctcggatcgcgccgttccatgcggggacaaacagtatttcttcaatcggcctgcgtgttccggatgcacaagcgcttcaatattggaaaaaacgatttgaagagcatcaggtctctcacagtgagatcgtgaaaatagcgggcagggacacactcgcttttcaggatcatgaaggacagcggcttgtgctgacagctgacgaaaaaggaaaagacatcggtgaagcggtgaagcaaagcggcataccggaagaatattctttccgcggtcttggtcccgttgaattgaccgtcccgtacccagaaccgacgctgcgtgtgttaaccgatgtgctgggcttcactgaaatcgggaaagaaacacatgaagaccggggcatggttacggtgctcgaatccggaaacggtggcgcgcgtacagaagtccatctcattgaaagaaacgatcttccgcgcgagcgtcctggaaaaggcagcgtgcaccatgtggccttccgtgttcagaatgaggaggagcttgctttatggcaccgcatcattacgaaagaaggtttcagcaactcaggcattgtagagcgttattatttcaaagcgctgtacttccgggaaccgaacggaattctgtttgaattgtcaacggacggtccgggatttatggttgatgaaaaacctgaggagctaggcaaaacggttgcgctcccgccttatctcgaacaccgccgttctgaaatagaagcgcggctgaaaccgattcagtaaatcagaaataatgaaagatgccttccggcttgacgggggcatcttttttttgcttttttacccgttttgtcattctttttacctatttgtaaacggcaaaataattgtctttgtttattaataaatttttcacatttggttgttacacttgttcaaagttaaacaaaaggagtgaaaacacaggtgaaaatgaaaaaacgcgagatagacgcggtcttaatcctcattttactcgcttccgcattcttgaatatgtacaacatctggaatgacgatacggtgaatccttattacaccgcagcggtaacgagtatgcttcaaagctttcataatttcttttacgcttcatttgacgcagccggatttatcacggtagataaaccgcctgttacataccagattcaaacgatcagcgcgctgatattcggtatgcacgggtggagtgtcatcctgcctcaggcattggcgggggtaggttcagttctattcatgtacttattaataaagccgacgttcggaaaaacggcggcgcgcatcgcttcgtttgtcatggcgtgtacgccgattgctgtagccgtagcgcgcacaaacaatgtcgatgcgttactggtctttttcctcttgttcgccacatggcttctctttaaagcgattcgaaaaggaaaactgatctggcttttggcggcattttttgtcgtcggagtaggctttaacacaaaaatgcttcaggcttatatgatcttaccggccttcttgctgttctatatgatggcggcaaataccacgattaagaaaaaaatcatttcactggtaagcgcgctggccgtattagcagccgtttcattgtcatggccgctcattgttgacaatattcctacagacaaaaggccatatgtcggaagcagccagacaaactccgtattggaattggctttcggatataacgggattcagcggctgacggggcaaagttccggcggccagggcgggcccgacggaaacgcatcgaaagagatgtcttcttccggcggttcttcacaaatgcaaaaaccgcccggccagtcagcaagcggagacaaatcacaaaccggcagtatgacggcacctccatctaacggccaaatgccaagcggcggtcaaggaggccctccaagcggcggagatggcggcaatggcggtcctggcggaggaaaaagcggtacaggcaccggctcgaaaatgcagtcaggttcaggaatgttcggtacgggaacacccggtccgctgagactcttccaacaagaattatcagatcagatcagctggctcctgccgtttgcgatttttggattggccggtttattgatcgccggggcgagagaaagaagaagattatcagcagaacagaaggaaacgatcttttgggcagcgtggcttgtgccgattgccggattcttcagtgtggcggaatttttccaccattattatctcattatgctggcgcctccgattgctgctcttaccggtgcgggatgggtcgccctcgttcatctgtaccgcaagcaggcgggatggaaaacttggctattgccggccgctattcttgtgacaaccggatttgaactgtttatcctcagaaactacaatgatcaaatcggcgcaggctggagcatcggagcaggcgttctcggcgcagtggcagcaatcgccctgttcgtattcaaacagcgccaaaaaccgctcagttactatgtttcacttgcagcccttctcgtcttgatggtgatgccgatttattgggcaagcacaccgcttctgtacggaggcaacagctcattgcctgaaacaggccctcagcttgcgtcagcaagcggaaaaggcatgggaatggataacgcatctgtcaatacaaaactgatcaactatttagagaaacataacgccggagcagactatctatttgctacaaccgattccaacacagcggcgccttacattataaaaacgaaaaaagcggtcatggcgatcggcggattcagcgggtctgacccggccattacgctgactcaatttaaaaagctcgtaaaagaagggaaagtaaaatacttcttaacatccggaatgggcaaaggcggaaacaacgatattgttgaatgggttgagaaaaacggaaagaaagtatcttcagacaaatggcaatcaagcacagatcagaaaacgaaaaatcatgatgcagctgatacaaaaagcagcaaggccgcgggtaaaaacagccggatgagcggcgggccgggcggaatgaatcagtcagcttcactatacgaacttcaatctgatgaataggaggaaaaaacatgagcagacatattcaatattcaatagtcgtcccggtttataacgaagaactcgtcattcagacaacctatcagcgcctgaaagaagtcatggatcaaacaaaagagcattatgaattgatctttgttaatgatggaagcaaagaccgcagtattgagattttaagagagcaaagtctgattgatccgagagtgaaaattattgatttttccagaaacttcggacatcagatcgcgatcacagcgggcatggattatgcagaggggaatgcaatcgccgtcattgacgccgatttgcaggatccgcctgaattaatccttgatatgattgagcagtggaaagaaggctacgatgtggtgtacgccgtcagaacgaaacgaaagggagaaacctttttcaagaaacagacggcctctctgttttaccggctgctgcggagcgtgactgatattgatattccgcttgacaccggagatttccgcctgctggacagaaaagtctgtgatgagatgaaaagattaaaagaaaaaaacccttttgtcagaggactcgtcagctgggtcggctttaagcagactgctgtagaatatgaacgagatgagcggcttgcgggggaaacgaaatacccgcttaaaaaaatgctgaagctttccatggacgggatcacaacgttctctcataaaccgctcaaggcggcaagctatgcgggaatgctcatgtccggagcgggttttctctatatgtttatcgttttatacatgaagctttttacagacagcaccattacgggctggtcctctctgattgtgatacagctgttattcagcggcatcgttctattaatgctcggaatgatcggcgaatatatcggaaggatttatgacgaagcaaaagaccgtccgctctatatcgtgcaaaaagcgtacggtatgaaaaacgaaaagatttatcgggaccagcatatgtcttaacaaacaccctgtccggccggcggacagggtgcttttatgtaaaataaaagccgcgggatgacagaatgtcccgcggcttttttcattcatctgcggccggtctgcgtgtgcagagagcgcatgatcagtccggttcccgaaaggttcagtaaaatgcttgcaccaagcgtcattccccaagcagcgttttgctgaggaagctgaatgctcagctgcagcaagatcaggccggtaacgaccagcaaaagtccggtttgtttcatgtgtatgtatcctcctttgcacactgagtcatacggctgatccaggcctaaagtttcagctgtatataaaaaaatccaaggcggctgccttggatttttgttaagaagatgtttcttctttttgagtcagtttcatttttttcgtcatttccttgccgtttctgataatcttcacgtcaacggtgctgccgactttcgtattcttgtagagaatattgcgaagttcgctgcccgtgtcagtttctttcccttttaagctgataatgatgtcttctgcttttaatccggctttggcagcaggggatccctgcgccacttcgcgaatgtaaacccctttattcagctgtttgccgaagaggccgagtgtgccttcctgatagttttgcggcacttgttccaagtcgatcatgctcacgccgatataagggcgctccacctgtcctttcgtgagaagctcttcggcgatcggttttacatcgttgctcggaatggcaaagccgatgccttctacatcattttcgctgattttcatgctgttgatgccgatgattttgccgtctgtattcaagagcggtccgccgctgtttccgggattgatggcggcatcggtttggatgacgttgatgcttgactcaccggctgacgtggagatcgagacggttctgtttaagccgctcacgatgccctgtgtgacggtgcgggaaaggtcttttccgagcggatcaccgatggcgatgacggattcacccgttctgagagcggatgagctgccgaagcttgccgtttttgttacgtgtttatcactgatttctaaaacggccaagtctgtcagagagtcgctgccgacgagtttagctgttacatcggtgccgtcatataatgacactttaagggaagaggcgccttcgaccacgtggttattcgtaatgatatacgctttgccgtttgctttcttaaaaataacgcctgaacccgatcccgtttccgcatcatcacccgatgaattagagtttgaatctgagcttgatccgaatccgaataaatcggaactgctttgctgcttttgcagattagtgattccgacgatcgccggtgaaatgtcttccaccatattcgaaatgctgcttgaatttgccgatgagctgtttgccgatttgccgctgccggattcagaagatgtctgcttagcggttaccgatgacgtttcctgagcgggagccggattggaagtatcttgagtctgatggtctccaagcggcgtaaatgtatagatgccgagggcgagccctccgccgatcactccgccgagaagcggtctgaaccagccgaagcttcgttttttcttgtcctcgtccggcgcggaatatccggccggctgcgggttttcttttactaaaaggacttcctgttctttttggtctgtccgattttcatcacgatagttatccatcatgttcactccgtttctctatttcatcatagcatgatttgcctattattactgactccatcttaaacaaaaagtgtgggataataatgaaaagattgtgggaaattgtgaaaaagacgaaatcggacggcggcgctttatattgacaatttccatcggatttgaaataataaatgagatattatgttcaatccttcacatgaaaagatatgaaaaattctgttaagctaatgggggaaatctgttagctttttcactttgtcaaatagtaagaaaggagctgtcaaatgaaagaaaaacatcactggatcatttctctgcttgctgtgctggcggtcgggccggggctgatgtcgaataccgctctttcggctgtccaaagccttgtccggcagacggtcggcggggaaaactttgactctcttcatccgattattatcggtaatatggcatttgccttattcgtgccggcggggccgtatttaagaaaaagattcggctcccggcctgtctatatgatttcgatggccgcgggtgtcatcggagcgctgcttgctgctgtgacaaatgatatttatccgctcgccgcgggccgttttttacagggagctgcggcgggcactatgctgatgattatgattccgatgctggtgctttcgtttccgattgaacgccggaattacgcattatttgtgttaatcggcggattttacgggtccgtcattatggggaccgttttaggcacggcggcggcaagcgccggccattggcattggctgttcggcatttttggcctgctgtcttttttcggcctcattttcagttatatgtggctgagggatgacgttcataaaaatgctgaaaaatctccatttgacggcatcggttttctgttagcgggtgtatcagctgtgctgaccgcctatacatttattcatctgccgaaatggggcttttcatcatggcagacattggcgggatttggaggaagcatcgtcattcttctgatcttgctgattatgcagtacagaaacgaacatgcgctgatttcgattaaacttatgctgattccaaagccgattttgggtgttttcatgatcgctgcgggcagtatttccatagcggtcagtctttctgcatttcacggggagcttcagaccgcatatcacatgtcacaaactcaacagatattcctttatgcgagccttttgggaggcgtggccatcgccgctgttatcagtgcattagcatatgataaagtcggtccgggcatgctcggcataacaggctctgttatactggtgttcgtgaatttccaatggatgacggcggatcatcatataccccttattctatttgcggggcttttcgtgatgctggcggccgggacagggcttatcgtggcagccggactgatgggagccgcgttgggcggaccgcttccggaactggtgaaacgcatgacggccgttcagtttttgaggctgttcatttatatgggcgcacctgttttaatagggtattttacgaaaagagatgcttccggcatgcttcggggcgcgcgcggcacacaatcgccgcatgacctgctgatggggacatacagcgatttgtttcttattgctttcatcttaagcttgcttttagtgtgtttatcatttgtcatgaatgcgaccggcatgggacataagctggcgcataaaccgcatgccgtccgtaagcaggcggatgaagagccttcgccgcaggctcctggaccgatcaggcatcaggtcattcccgatcgcgaatacagaagtgcggtcagacagtttcggggtcaccctatcaacaaaaacggtatgtaactttttctatcagcaaacccttttcccggtgaaaagggtttgttttttcctataatggcagaatggtatattgcatgtttcatccttttttaatataatttgttagaatattcataatttaatatcgaaattttaagtaaaaaaggaggcattacatgaaactgtatctatctgtggatatggaagggatttccggactgcctgatgaaacatttgtcaattcccgcatgcacaattatgagcgcggcagggttctgatgaccgaagaagcaaactggtgcatcgcagaagcgtttaataacggatgcacggaagtgaccgtgaatgacagccactcaaagatgaataatctgctcgcggaaaagcttcaccctgaggcagagctgattacgggggatgtcaagccgttttccatgatgcaggggcttgatgaatcgtattcaggtgtgatgtttatcggctatcatgcgagagcgtcgatgccgggcgtcatgtcgcacagcatgatattcggcgtccgccacttttacataaatgataagccggtcggtgaactggggttaaatgcctatctcgccggattttacgatgtcccggtcatcatggctgccggagatgattgcgccgcaaaagaggcggaggagctgatcccgaatgtgacgactgccgccgtcaaacaaaccatttcaagaactgcggtcaaatgcctgtcccctcaaaaagccggacggctcctgacggaaaaaacagcctatgcgctcaaaaataaagataaggtcaaaccgctgactccgcctgaaagacctgtattaggcattgaatttgccaattacggacaggctgaatgggcccatttaatgccgggcacagaaatcatcccgggaacgacaatcgttcaatttcaggcaaaagacatgccggaagcctatcaggccatgctcgtcatgacagaactcgccatgagaacaacattctgttaaaggggtgaacggcattgctgcggtattttatcaaacgttttatcgccatgatgatgaccgtcctcgtcatcaccactctgacatttgtcatgatgaaagtgatacccggctcgccttttaacgaagagcggggcacaaacgaagcggtccagcgaaatcttgaatcctactaccatctgaacgaacctcttatcactcaatacgccatctatctaaaatccattcttacctttgatttcggtccttcaatcaaaaaaccgtcagacagtgtaaacgccatgcttgaacgcggatttccggtttccttcgagcttgggataacggcgatcatcatcgctgtgatttccggactcgcgctcggcataacggccgctctcaggcgcggcggctttctcgattatgcggccatgagccttgcggtgctcgggatttccattccgaattttataatggctacgctgctgattcagcaatttgcggttcatctgaaatggtttccggcagctacctggacgagtccagttcacatggttctgccgactgttgcgcttgccgtcggtcccatggccattatcgcgcggctgacaagatcaagcatggccgaagtgctgactcaggattacatccgcacggcaaaagcaaaggggctttctcccgtcaaaattgtgatcaaacacgcattgaaaaatgctcttatgcctgttgtgacagtgctcgggacgcttgccgcaagtattttaacgggcagtttcgtcatcgagaaaatttttgccataccgggaatgggcaaatatttcgtagaaagcatcaatcagcgtgattacccggtcatcatgggaacgaccgtattttacagtgtgattctgatcgtcctgctgtttctggttgatttagcatacggcctgttagacccgcgcataaaacttcataagaaagggtgatcctgatgaatctcccgcaagaaacggtaaaacacacagaagtgcctgatgactggtttcagccgggcgcggaaagaaagggtgaaaccgagtcggtcaagcgtccgagcctgtcttacagtcaggatgcgtggcggcggcttaaaaagaacaaattggcgatggccggacttgtgatattatgctgcctgtttctagcggctgtgttcggcccgctgatatcaccgcacagcgtgacaaggcagacgctcgccgagcagaatcttccgccgtctttttcacactggttcggaaccgatgaacttggccgggacgtgtttacaagaacgtggtacggagcgagaatctctttatttgtcggtgtgatggcggcactgatcgactttttgatcggcgttatctacggaggcgtcgcgggctacaaagggggccggacagacagcgccatgatgagaatcatcgaggttctctacggattgccgtatctgctcgttgtcattttgttaatggtgctgatggggccggggctcagttccattatcgtcgctctgaccgtgacgggatgggtcggcatggcgcggattgtgagagggcaggtgctgaggatgaagcatgatgaacacgtattggcatcgaaaacgtttggagcgaaaacatttcggatcattaagaaaaatctgctgccgaatacgatgggagccattattgtccaaatgacgctgacggtgccggcggcgatttttgcggaatcatttttaagttttctcggactcggcattcaggcgccgtttgcaagctggggagtcatggcaaatgacgggctgccggcgattttatcaggccattggtggcggctgttttttcccgcttttttcatttccttaacgatgtacgcgtttaacgtgcttggagacggcttgcaggacgcgttagacccgaaactgaggaggtaggaaaaatggcgcagcaagttctttccgttcaaaatctgcatgttactttttcaacatacggaggcactgtaaaagccgtgagaggcgtcagcttcgatttatataaaggtgaaacgtttgcgatcgtcggtgaatcgggatgcggaaaaagcgtgacgtcacaagccgtgatgagtctacttccgaaacattcggcaaagattgaatccggaagcatacaatttaaacagaaagacctttgccaaatgtcggatcgggaaatgcggggaatccgggggcgcgaaatttctatgatctttcaggacccgatgacggcgctcaacccgactttgaccataggggatcagctatcagaagcgctgttggaacaccgcgccatgacaagaaaacaagctgaatccgaggttctcgccatgttggatctggtcggtatcccggactcgaaatcccgcctgaagcagtacccccaccaattaagcgggggcatgcggcagcggatcgtgatcgcgatggctctgatctgcgagccggaaattatgatcgccgatgaaccgacaacggctcttgatgtgacaattcaagcacaaatccttgaattatttaagaagattcaaagaaaaacaggcgtgtctattattctgatcacccatgatctcggcgtcgtcgctcagaccgccgacagagttgccgtcatgtatgcggggaaaatcgccgaaatcggcacgaggcatgatattttttaccgtccggctcatccatacacaaaggggctgcttcgttcagtgccgcggctggatatggaggatagtgagctttcgccgattgacgggacgccgcctgatttattcgatccgccgccgggctgcccgtttgccgcccgctgcccggacaggatgatcgtctgtgaaaaggtatacccggcaacaaccgtgaaatccaaaagccatatcgtcaactgctggcttcaggatcaccgtgcagagcggctgaagcagcagctgacggcagcagaggaaaaagggggattgaaatgaaaaagagatgggcgatcggtgtgattgctgttgtttcgtttgctctgatgggctgtacagccaatgaacaggcggggacagaacccggcaaagcaaaagaacaggggggtgagacggtgctgcggctcaataacgaaaatgagccgacctcacttgatccgccgatcggatttaataatgtttcctggcagccgctgaataacatcatggaaggattgacgaggctcggaaaagataataagcccgaaccggccatggcggaaagctgggaggtgtccgctgataagctgacatataccttcaatatccgtgataacgccgaatggacaaatggcgatcccgtcacggcggaagacttcgtgtacgcctggaagcggatgctcgatccgaaaacgggcgcatcttccgcttttctcggctacatgatcaaaggcggggaagaatttaacagcggaaaaggcaaacgagaagacgtgaaagtcacggcaaaggataaaaaaacgcttgtcgtcacattggcggccccgcaggattattttttgagcgtcgtgtccaatccggcgtatttcccgattaatgagaaggtcgccaaggctgatccgaaatggttcactgaagcaaaaacttttgtcggcaacgggccgttcaaactgacggaatggaagcatgacgacagcatgacgatggtcaaaaacgagacgtattgggataaaaagacggtgaaactggataaagtgacatgggcgatggtcagtgaccggaataccgactatcagatgttccagtcgggggatttggataccgcctttgtgccggcagagctgagcgagcagctgatgggaggaaaaaatgtccgcacctgggatcaggccggactctatttctatcgttttaacgttaaaatggagccgtttcaaaatgaaaagatcagaaaagcgttcgcggcagcgattgatcagaaagaaatcacggattatgtgaccaaaaacagtgaaaagccggcacatgcctttgtatccccgggatttactcagcctgacgggaaagatttccgcgaagcgggcggcagtttactaactccggatgaatcagaagccaaaaaactgctggaaaaaggcatggcggaagagcattatgacaagctgcccgccgttacattgacatacagcacaaaaccggagcataagaaaatagcggaagcgattcagcagaagctcaaaagtgtgctcggtatagacgttaagctcgccaatatggaatggaacgtctttttagaagagcagaaaggactgaagttccagttctctcaaagctcatttttaccggattacgcagatccgatcagttttcttgaggctttccaaacggataattccatgaaccgcaccggctggggcagcgcggcatacgacggctgcatcaagcaggcaaaacaggaagccgatgccaaaaaacgttttgcgctcatgcataaagcggaaaagctgctcatgaacgaggttccgatcattccgatttacttttacaatcaggtgcatctgcagaacagcggcgtgaagggcattgtccggcaccccgtcgggtacattgatctgaaatgggcggaaaagtcctgatcttacagcggaaacatatgccgctcttttgccgttaaaggagcggcgtgtttcacttttcaatccggaaaggagattgaaaaagtcatgaaccataaaccgaaagcactgcaaaaaggcgacacggtcggtgtgattgcgcccgcaagcccgcctgagagcgggacgctgcaaaccgcgctgctgtttttagagaatgagcttggccttcaagtgaaactcggccgggcgctgaagacccgtcacggctatttggcgggagaagaccgggcgcgcctcgatgatctccatgacatgtttagtgatcagaatgtcaaagcggtgatatgcgcgtgcggaggattcggcacgggccgcattgccgccgacatcgatttcggcttaatccgccgcaatccgaaaattttctggggatacagcgatattacgtttttacataccgccattcatcaaaatacggggctcgtcacatttcacggcccgatgctgagcacggatgtcgggcttgaagatgctgatcccctgacaaaagcgtcgtatcatcagctttttacagaaacggaattcacctatacggaggacatttctccgctggaggtgctgacaggcggaagggccgagggagagctttcgggcggcaatctgtcgctcattacatccacactcggcacgccgtttgaaattgatacgaaagacaaattgctgtttatcgaggatattgatgaggagccgtatcaaatcgacaggatgctgaatcaattaaagatggccggaaaactgtcagacgcagtcggaatcctggtctgtgattttcaccaatgcgaaccgaagcataaagaaaagtctcttactttagagcaagtgctgaacgattacattgtcaaatcaggaaagccagcgcttaaaggctttaaaatcggccattgttcaccgagcttcgccgttccgatcggggcccgcgcggttatggatacggcggccaaagcggtaacgattgaatcgggggtttccggaagggagtgatcaggtgtgaggattacagatattcaaacgggacggatgtccgtgccgctgaaaaagccgtttaagaccgctttgcgcacggtttacaatgctgaatcggtcattgtgaagctcacatttgacaacggtctgaccggctggggcgaggcgccgccgacggttgtcattacaggcgacagcacggacggtattgaaagcgcagtccgcgatgtgctgaagcctgctctcttggggcggagcctttccggcatggaagctgttttgtatgatatcagccggctgttggaaagaaatcaaagcgcaaaagctgcggtggatatggctgtatatgacggatgggcgcaaatgcacggacagccgctttaccggcttctcggaggctatcggaatacactggaaacagattttaccgtcagcgtcaattctcctgaggagatggcgggggatgcagaccgctatgtgaacaagggatttcatattttaaagataaaagtcggcataggtgacatatcggacgatgttgcccggattcaggcgatcagatcacgtgtcggcggtaacgtcaaactgagattggacgccaaccaaggctggacgccgaaagaagccgtgactgcgatccgaaagatggaagacgccggcctcggcattgagctggtcgagcagcctgttcataaagacgatatcgccgggctgaagcaggtcaccgatgccgtagacacgccgattatggcggatgagagcgtctttaccccccgtcaggccttttgcgtgctgcagacgagaagcgccgatttaatcaatattaagctgatgaaagcgggcggcataaagcaggcggaaacaatcaatgccatggccgaaacatgcggcgtggaatgcatggtcggcagcatgattgagaccaagctcggcatcaccgccgcggctcattttgccgcgggcaaacggaatgtgacaaggtttgattttgatgcgccgcttatgctgaaagatgatttgattaaaggcggcatcacatacagcggcagtcagattacgattcccgatgaaccgggtctcggcattatcggtgtgtcgatacaagaggaggcgaaaagatgagagcagccgttacagcggcggcagccaacgtatggacgctgccgtcatctccccgttcgtatgatgcgccgatgcttgaaaacccgccgcagatcagaaaatggttagcgtctatgggatatgaagagcggctgcaattatgtacagacaaccttgtccaaacgcaagcgcttttcggggaagaggtgatcattctcaaagaggaaggggaatgggcttttgttgccgttcccggccagccttcaaacaaggatgcgcgcggatatccgggctggatgaaaaaaagccagctttcaaaagacggcttttatacatcttcccccgccgtatggattaccaaaccgacagcttttttatatcacacaaacggcgaaccggacttggaagtaagtttcttaacgcgtcttccggcatcaggacgtgagaacggcttttttcgggttgtgacgcctctcggagaacggttcgtaaatgaagctgacgcagacgagtaccggcatacggaaggacgggtagccgatgtcatcgaaacgggcatgatgtttctcgggcttccgtatttatggggaggactgagcggtttcgggtttgactgttccgggtttatgtattcgatatttaaagcaaacggctatacccttccccgtgatgcaaaggaccaagcaaaagccgggtgcggcgcggcggtaaacgatatccggccggctgaccttttgtttttcgcctatgaagaaggaaaaggcgcgatccaccatgtcggtttggcgctgggagacggccgaatgctgcactccccgaaaacgggaaaaacaatcgaagtgctgtctttggaaggaacgatctatgaaaaagaattatgcaccgtacgccgctgtataagcgaaaagggggaatagaaaatgacggcatctccgctccttgaagtcagcgggctgaaaatgcattttgacgcaggaagaaagaaagccgtaaaagcagtcgacggtgtcagttttcacattaaaagaggggaaacattcggacttgtcggagaatcgggatgcggtaaatcgacgctcggaagagttattctccgtctgtatgacccgacggccggttcggtatcatatgaagggacggatatacaccgtgccgcggcagaacagcggtcggtcttcttccgcaagctgcagatgattttccaagacccttacgcctcgttaaatccgcgcctgaccgtaagggaaattattttagagccgatggaaatccacaatctttacaatacaagaaaagcccgtctgatgatggcggatgaactgcttgaagctgtcgggctccacccggatttcggcagccggtatccccacgaattcagcggcggacagaggcagagaatcggaattgccagagcgctctctctgcatcctgaatttatcgtggcggatgagccgatttccgcgctggatgtgtcggtacaggctcaggtcgtcaaccttttaaaaaggcttcagaaagagaaagggctgacatttttatttatcgcccacgatttatcaatggtcaagcatatcagcgaccggatcggcgtgatgtatttgggccgcatgatggaaattacagaaagcgctgcgctttaccgggaaccgcttcacccttatacgaaggcccttttatcctcaatcccgattcctgatccgcttcttgaggacaagcgtgaacggattattctgaaaggggagctgccgagcccccttaacccgccgagcggctgtgtattcaggacgcggtgtcctgaagcgatggagctctgcggtaagataacgcctgagcttgaagaagtgaaggcggggcgttttgtcgcctgccatttatacaaaaaagaaagctgacaatataatgtcagctttctttttgattaaacctgatgcagaaatgacacgcagaccggatacggaaccggaatgtcagattgaagcagagtcaatttgcctgtttccggatcgcgttcaaacaaaaccagatttcccgtttcttcgtttgacgcgacaaggaatgtctcggaagggtcaaacgcgaaatcacgcggccagttgccttctgtcggcacccattcaataagagacaattcaccggaatattggttgatcttaaagatggcgatgctgtcatgtccgcggttggcggcataaagaaatctgccgtctttagatatgcggattgcgctgccttgcgatttgtccgtaaagccttcaggcaaagcggaaatgacctgcagctctctgaattcacctaaggtcgggttgtattcaagcgcgatgacttcattgctgatttccgtcatgacataggcgtatttttccgccggatggaaaacgatgtggcgcggccctgaacccggtgcgaaagaatgagttttcacctctgtgagcgaaccgtttttcatttggtacgtatacagcgtatccgtccctaaatcgacggctgcaatgtagttatgctcaggtgtatagcctgcgaaatgggtatgcggtttctcttgtctttcatgaggacctgttcccgtatgagcggcttcggcagccggctcctgcagacttccgtcctcattgacgggaaaggcgtgcacttttccgctgtggtaattagcggttaacacatattcatgtttatcatcaatgctgacgtggcatggagacgggccttcaatcagctggtggtttacaaacgttaattccccgctgttctgatgaatctgataggctgcgacgccgccttttccgtctgccttttcaatggaatacagcatgctgttatcagaattcggagtgacgtatgtcgggttgccgagctttgctgccagcttcggccggctgagcctcttcgcttctgtatcaagttcaaaacaataaatgccttcgcttccgccttttgtatatgttcccgcgtatcctatgtacttagccattcggtttccccctttagagtcttgtcttctctatattaacgtatcttgaaggaaactgccttgtaaatgtttaagatgttctgacaagcggcaaggtgcagcagcggaaggaaccgcctgacttaataatttcggaaaactcggtttcaatgactgtataacctctttttctgagctcgcggttcgtatggcggtgctgcggcaggctgataattgtctgattcccgatggacaggatattcgggccgagcgtgaattgctcttcttcaggaacttctatcatctcaaaacgttcggcgagaagatcaatttctttctgccgcaagccatttttgcagtatagcgcttccgtttccgagatcatattaaatacacagtccaaatgtaagaaatcctccttgagagggatcggcacaacagtcatctccggcagcgcctcccgcagctcccggacagccgctttatccgtgcgcttgctcagcccggcgtaaacggtgccgtctgcgatcaagatgtcgccgccttcaatgttcgcttttttcagttgcgtataagggattttcttatcgtcaagcaggtcttgaaacactttttcttctccctgccggactgaagccgccatgtttgaaataaacgccgtctcgcctaagacaaatccgatatcccgggtgaatacctgctcaggcaatgcgggatcggcaggcagcaggacgacttcaatctgatgagatcttaaaatgtcaataaactcactatgctgtttgagggcaacgggtatgttaatattttcttgttggaaatgtttctgcgttccgttaataatatccttgatggtcatgtgttccggccggcataagatgactgtctgcaaagcatcaaactcactgcggcaagccggtttccgcgtggatttgggaatggatacgtccatgtgatatcctcctatcggtattcaatgtgcgtttattattcccggatgtgatgaataatgaaacatttctgatagaatatctaaccaacttaatatttaaaattttagacaaaacgagcaaagtattgtttaatagggtacagatgaaatgtcaaaacgaccagacaccaaaggggagtttaaataatatgaagttgccagaatcaagattttgcaaagaaacaagggttgtcaagacaagcagggtttttccgcttgatacgaataatcacaatacgctgtttggcggaaagctgatgagctatattgatgatatcgcttcaatttccgcggcccgccactgccggtgtgaaacagtcacggcctcaatggattctgtagattttttgcgcccgatcggccaacaggattccgtatgccttgaatcctacgtcacatgggtcggcacatcctctatggaggtgtttgtcaaagtcattaaagaacacctgatgacgggtgaacgcgagcttgcggcaacgtcgtttctgacattcgtcgcgctcgattcaaatgggaaatcggtgcgcgttccgcgaatcgtgccggaaaccgaggaagaaatcatgcttcacaatacggccgtacagcgcgccggagaacgaaaaaaccgcttaaaacacagcaaggccctggccgaggcgctcggaacagataagccttggtaatcgtcaaaccgcttttttgaaaagcggtttttttatgctgaaaaaggacttttcctgccggatccataatctattacagggaaaggagacgtggcgtgcatgatgaaacataagtcttccggcaccatcctgacaaccgggcgtatccgtctgcggactatgcgggatgacgatgaagacaatttgtacgggctgtttaccgacagagaggtcatgaaatattatccttctcttaaaagcagacgggaaacgaaggaatggattgcctggaacaaacgattggccgcaggatacggcgtcagtctttggatcgcagaggataaagagacgggcgcatttctcggtcaatgcggaatcgttccgcagacgataagcggaaacactttgatggaaatcggctatatgtttgcccgccgccgctggggctgcggctatgcgacagaggcggcgaacgcctgtctggactacggttttcatacgcagcaatacggacgcatagcggcgctgattgatccggaaaacgctgcctccgtccgcgtcgctgaaaaaatcggcatggtgcccggtgagaccgttaccaaatgggggaggcggctgacggtatttgacatcacatctgacgttgaacgtttcgacgaaatgtagtatgatacgaacagacatgttttctagggttccgcatgttcatacatggcctggtccgagagaaaacacatatgcggacatatcccgcatatgcacacggagggaaaaaagcccgggagagtcaatctcatgtgagacgactattccgggctttttgtattgtccggaaacagaaaggatgaagaacatgaaatggggtttagtggttatagcggccgtatttgaagtggtatgggtcaccggcctgaaacatgctgattcagcactgacgtggagcggtacgattacgggaatcatcatcagtttttatctattaatcaaggcgacggacagcctgcccgtaggaacggtatatgcggtctttaccggactcgggacagcgggcaccgtgctcagtgaaatcctgcttttcaaagaacaggccgatccggtgaaaatcgtgctgatcggcgttttgctgatcggtgtcatcggattaaagctggtcacacaggataagcctgagacgaaggaggagaaggcgtaatgcattggatcagcctgatagccgcgggtctttgtgaaatgctcggggtcattttaatgaatcaatttcaaaaagaaaagaaagtcaagtggattctcttcataatcgtcggatttgcggcttctttttccctgctttcttatgcgatggagacgattgcgatgggcacggcctatgcgatctggaccggtatcggcacggcgggcggcgcactagccggcattcttttctacggcgagcagaaggatgcgaagcgcatctttttcattgcgcttattttgtgcgcagccgtagggctgaaaattctttcgtaaattgatttttatcaaattttcagtataatctataataagttacgaattatgaagatacgagggattaaaacagatgaattcatatatgacacagcggctgaaagaataccgccgcgggaatgaggaaaaagggcgcctgcttgtcagctgccccgatcagccgggaattgtatcggctgtgtccgcgtttttgtttgaacacggcgcgaatattattgaatcaaatcaatatacgactgaccctgaaggcggacgtttttttctcaggatcgaattcgactgcaagggcattcgtgagaaaaaagaggatttaaagcaggcgttcgcctcaatcgcccagacattcaacatgacatggagcctctctctggcaagtgagctgaagcgagtggcgatctttgtatccaaagagctgcactgccttcatgaactcatttgggaatggcaaagcggcaatatgatggccgaaattgcggtcgtcatcagcaaccatgaagaggcgaaagaagtggtcgagccgctgaatattccgttccattacatgaaagctaacaaagacatccgcgccgaagttgagcggcgccagcttgaactgctggagcagtataagattgatgtgatcgttcttgcccgctacatgcagattttgacgtctgattttgtatctgcccatccgaatcggattattaacatccaccattcattcctgccggcctttatcggcgctaatccgtataaacgggcttatgagcgcggagtgaaattaatcggcgcgacctctcactatgtgacggacgatcttgacgaagggccgattattgaacaggatattgaacgcgtcgatcacagagatcacgcagaggatctgaagaatatcggcagaacgattgagcggagcgtgttggcaagagccgtaaaatggcatctggaagaccgcgtcatcgttcacggaaacaaaacgatcgtatttaattaatgacggtccgccggggaggcgggctgttttttatggatgaaaatgtcttgacaagaacctgttttctttgcataatataaaaaaatcattgagcgttgaagaggatcagtacgcagaactttctgtgacagagagcaaaatggcccgctgaaacattttgccgcatgaaacctgccgaacctgccttggagtcctgaggggaaaactcaggcgcgatacctggcgttacaggaaagcgggacgcgtgaaaaacgcgttcaaacaaggtggtaccacggaaagcccatttcgtccttatttttcaggacggaatgggcttttttttattgacgagagccggtttggatttattgccacggaggagaaacgatgaaaaaacaaagaattgttgtgaaaatcgggagcagctcgctcaccaacagtaacggaagtattgatgaagcaaaaatcaaggaacatacggaagccatttctttattaaaagaaaacgggcatgaagtgatcctcattacctcaggcgcggtagcagcgggtttttccgctctcggctatccgtcgcgacccgttacgataaaaggaaaacaggcagctgccgcagtcggccagacgcttttaatgcagcaatatatggaccatttaaaaagatacggtctgacgccggcacaaattttattaacaagaaatgatttctcaaaaagagagcggtacagaaatgcctatgccaccgtaatggaactgttggagcgcggcgtcgtgccgattattaatgagaatgattccacatcagtcgaagagctgacgttcggtgataacgacatgctgtcggcgcttgtaagcggtttgattcatgcagaccaattaatgattctcacagacattaacgggctgtacgatgccaacccgaatgaaaacccggacgcaaagcggtttgactatctgaatgacatcacacctgaattgctcggatatgccgggtcagcaggctcaaaggtcggcaccggaggcatgaagtcaaaacttctcgccgcccagaccgcattgtcgctcggggtgaaggtgtttatcggaaccggctccggacgtgaaaaactgatggtgattttagacggaaaaggcgacggcacttatatcggcgataaagacctgtcctcagtgaataatacacggcaatggatcatgtttcattctccgatatcaggggaaattatcattgatgggggagcggagcaggcgatgatccataacgggtcaagtctactcccggccggcgtcgccgatgtctgcggcagttttccgaaaggagccgtagtggaagtcagagggcccggcggcattatcggcaaagggcagacgcagtactcatccgatgaaattttagaagccaaagggaagcggagcgaccagctttcaggaacgaagcaggtggaagtgattcacagagatgattgggtgaatttatttgacgagggggaacacaaatgagtgaagtattgcaaaaagcggctttggcaaaagaagcggctgccgaaatggtcatgaaaacgacggctgaaaaaaacgaagcgctccaatgtattgcagacggcctcagaaatgaacggcagctgattttaacagagaatcagaaagatattgaagcaggacggaacagaggactgacagctgacattattgacaggctgacgcttgatgaaaaacgcctgctcgatatcgcggacgccgtggaactgctaatcggtcttgaagatcccgtcggtgaatcattggagaccattcaaaaagagaatggattatctattgaaaaaatccgcgtgcccctcggagtagtgggcatgatctatgaggccagaccgaacgttaccgtagacgcggccacactctgtctgaaaaccggaaacgcggttgtgctcagaggaagttcttccgccatccacagcaacatagcgcttgtcagtgtgatgaagcgcgcactgggactgtcaaagcttccgattgatgccgttcagctcatagaagatacaagcaaagaaaccgccaaacagctctttacattaaatgacgggctggatgtattgatcccgcgcggcggtaaaaatttaattgatcttgtggtcagggaatcaaccgtacccgttttagaaaccggagcgggcaattgccacgtgtacatagatgagtcagcagatcctcaaatggcaagcgaggtcgtcatcaatgccaaaacacagcgtccttcggtctgcaatgcaattgaatctcttttgattcatgaaaaatgggccgaagaacacgggcgaaagctgctgaatcagctgacagaaaaaggggtggagctccgaggagaccaggtgatttgcggactggagcctcaagcgaaacaagcagaagaagccgattggggagcggagtacttggcgccgattctcagtgtgaaaacggtgcaggacgtacaggaggcggtccgccacattcagcagtacggcacaaaccattcagaagccattctgacggagaacgccgagcatgcggcttacttccagaccgccgtggacgccgccgccgtgtatcataatgcttcaacccggtttacggacggttttgaattcggatacggagccgagatcggcatcagcacgcaaaagcttcacgcgagagggccgatggggcttccggcgttaacatctacaaaaatcatcatcaaaggaaacggacaaatccgggtataatcttttaagcttatccttcaaaaagggtgagctttttttatgcggaaagattgacggcttctattatattttgtaaaattaagttgtgcacaatataacagaggtgaatttacatgacaaaaccattatttactgcaaccgtttcagccgcaggcggacgtgaagggaaagtcacgtcttctgacggggtgctgaatcttgatgttgccatgccgggaacgccaagagcaaaaaagctcgaacaagctacaaaccctgaacagctgtttgccgcaggatattcagcctgctttgacagcgctcttcaactcgtagcaagaaaagagcgtctgagtattgaaacagaggtcactgcgcatgtcagtctgctgaaagatgaaagcgaccaaggatataaactcggtgttacgcttgaggtcaaagcatccggcattgagaaacaggagcttgaagcccttatccaaaaagcgcacggtgtctgcccgtattcaaaagcgacggcgggaaatattgaagtgaagcttctggcagcagaataaaaataaggatgcccattcggggcatccttattttttgccgtgcagcgttttcaaaacctcataaagcgactgttttacctgctttaattcctcttttgacagtcccgtctgttccagcatggcaatggggatatccgccgctgtattctgcaagacccgtccttcatctgtgagcctgatcgtcacggatcgctcgtcttcagccgaccgctttctcatgatgattccgtgctgctccatccgtttcagcatcggtgtcagcgttccggaatccaagtgcaaaagctcacccatccgtttcacattcagttcttcgtgctcccataataaaagcagcgtcaaatactggggataagttacgttgagcttatcaagcagcggtttgtaccgttttgtcatttcccttgagcttgcgtacagcaaaaaacaaagctgattctccagtttcatatgttcaaaatctttttctgccattacttctttcaccaactcttttttgttaacgttacccctattgtagccgaaaaacggcccatttcctattgcaatcatgtttaaaaatatgagcaggggcaatatatacagtaagtacaatgaggaggctgataataatggcattatttacttcaaaagcgaccgcagtcggcggacgagcaggacatattaaatccgaagacggggtgctggattttgacatcatcatgccgaatgcaaaaaaagacggagaaaccggcacaaaccctgaacagctctttgcggcaggatatgccgcctgcttcgggggagcgcttgagctcgccgcccaaaaacaaaaaatcgacatgacctctgaaattgaaggacaggtcagccttttaaaagatgagagtgacggaggttacaaaatcggtgtaacgctcgtcattgatacaaaagatcttgataaagaaacggcggagaaacttgtgcacgccgctcacgagttctgtccgtattcaaaagcaacaagaggaaatgtagacgtcaaacttgaattgaaataaagaaacgaacgaatatcccggatttcatatccgggatattttattaacgaaaacatcagtaatgatctcttctctcccggaataagaatacgatatagcacttttgcataatgacaccaagagaaaagagggagaaatcgatgtctcttccaaacataccgaacatcacccccgacattacactctccagatgtgagaccctgaacctccttctttcatccgtggctatggaagaaatcggactatcccatattctgcaggcggaagcggaaaggattcaaatgtttctcagcgcttccagcgatccctccttaggggaattatcatcaatcaatagaagcactgaacggctcctgcgcaccgtcatgaaatcacaactccttttgcagacgaagcttgaagacattatctacttacaggatgctgaagcctgtatagaaccggacgatccaagtaatccaagtgatccaggcgatcctgatgacccgtggaatccggatgatccaagtaatccgagtggtccgggtgatcctgatgacccgtggaatccggacgacccaagtaatccgagtgatccgggcgatcctgatgacccgtggaatccggacgatcccagtgatccggaagatccgtgtgacgacctgttttacggccgcattggctgctgtgagtgcggggattgtgaggaatgcgattggaagaaaaaaggcggggagcgttcataaaaaaagacgggtgaagcatatgccgtatccaagcatctcaaaagcgaaacagacatcttttgaagccttgcattgtctcacgatggcgctgttaaatatattatctgtgaccgtggataaaagaaggggttcaaattacaaagaagaaatcaggctgttctccgcattgtgccgctggcagatggaaacaggcggccggctgtttttaatgatcagcttggaagaagaacagaagcagatgtatgagcggcactttcatgaaatgaagacagtgacggaacgaacgaaaaaattcatttttgaaagcccgcgcgaatttcgggcgcatcccattacgaagcgggctgtcaggcagcttcaggaatgggatgcagaatcaactgccgaacctgccgtcagatgggtgcggcctgtcatcataacgatgaacggcactcctgaacggccttggttcaatcaacaactccaaaatcgggaaaggtgagaaaatgagcggaaatgctgaatgtaaactgactctttgcatgattgtgaaaaacgaggagagatacatctcccgttgtttatcaagtgtacaagacatcgctgatgagatcgtcatcgcagacaccggatcacaagataatacaaaagatatatgcaaaagctttcaggcaagagtgtttgatttcgaatgggagaatgatttcgcaaaggccagaaattacgccctgcagcatgccgaaggggattggattttagtgcttgacgcggatgaagagctcgatcaggagacgggccgttttttaacttcgctgcttcatgacggattaccgagccggggacttttgaaaatcatcaattatacggggaagcagctcgatgaaaacgaagcgtttgaaagcatgcagccgaggctgttccgcaatcataaaggccttctgtatcaaggcagaattcacgagaatatctcggctcccaatgaggaagaaaacaatgcttttttcacgctcccatgtgtgattcatcactacggctacttggagcaggaagaaaaaatcaagcaaaaacataaacggaatatcagcatattaaatgaagaactttcagaggaaaatcctgatccgtggctagtctatcatttggcaagtgaatgttacagaataaaagactatgaaaaagcattacatcttgtcaacggctcgatatttcaatttttaagtgagaaacgaatgcctccgtctcttctgtattttctaaaatatacaatattgcttgagctcaagcgatatgaagaagccgaacaagggattgaaaaagtgctcaagctttatcctgattacagcaatcttcattattataaaggccttgtattatatcatttggaaaagtacagagcggcaatcaaagcatttgaagccggaactcaggttgaaggagaaaacgctgatcacttcattttaaaaggtgccggcgatttcagagctttttattatatggcgaaatgccatgctgcattaaaccatgatatgacggccatcgcttacgccaaaaaatccgtgaagttcaatccgcaatttaaacccgcgcaagaacttctgtctcaattaaaaaaggatcagcggacaaacgcctgatccttttttttgcatgttccattaagataatcgaataatgtttaaagctgcgccggcacttcctccaagcaatgtggccgcacccaataatccgaacagctggagctgaatggtgctgcctgctgtcaaagtcacaataaaggagttattgaagtttgccaaagacgcgaccggggcaataatcgaacttgcagccggagtgccgttgattaagatgcgcgaacttactagcaggccggccgttaaattaatatggtaggaaatatagtaccgtcctgccggagcaacggtgaatacagtatttgcggcattagcggtaatatccgctgagaggttttgttcattcggtaaggaaatggccgtgccgccgttaataactgcgacaacaccgccgcccgtattgctcgcatagccggaagtggctgtcagacttgttccggtgcttcccggaggccctgtaatgccggtagccccggtaacaccggtcggtcctgtaacgccagtaattccagttgatccagtaccgccagtaaccccggtaactccggtaggtcctgtggagccagtagcgccggtgcttcccgccgcagctaaaagtgtatagtcagctgaggtttcaggggttcccgacgggctgtttacgtttgcgacataagagctgccgttatacaagacaacctgtccggtcgtgtaagtaggggcggtcagcggattaaaagcaacaatcccttgaagacccgcaccggtgacccctgtcggcccgatcggtccggttggccccgtcgctccggccgggccgattgctcccgtcggccccgtggcaccagtcggccccgccagtgtagggatatttgagatactgtccaattttgaaccgagaagaagctcctgtttcattaagctgtcaagcgtatcccggacgctctcattcagattaagaatatccgcaagacttgacgggggtcctgttaatccgggaatcgttccgagcgcgtactggattttttccccttccgcattcagaatatgtgccattcccagctcttccatagcaattgacgaaagaagaaggttaatggtatcgtctctggaaagtgtaacgacaggggtgatattgggcaaattaggctgtgacacaatgtccctccttatgagttggctgaaaatcattttattacgaacaaagttcccccaaatgagcgtaagcagtactgtatcattatattcactgattctgtccaagtttctgaacgaattctcttcattactttcatcatatatgaaggaaatactttaaatatagagaaaatacatcgcacagcattcgcaaatcggtcaaaatgacagcgggacatgtgatcgtctataaagcgatggctatatatcttgtgcgtttcctgcaaaaacgctctttttcatttcaagttttctgtataaaagggcgagaagcatggacggtatcgtacaaacaatcattccgataaaggcataccggggttcaatttcatataaaaaacctccgaaaatagtaaataccgcagtgctccagctgagagcaagcgctgaatatatgccttgggctttcgggatttgcgcgggtgaaatatttttaattaagtatttcataaatgcatagtgtcccatcgcgaatgaacaggcatgcagcgtctgcgcaatacagaaaatgatgacatgcggaaaggcaaatacgagtatccagcgtacggtagcaccaagcgccgccagggcgagcaaagagcctgccgtaaattgatgaaagtatcggtcagcgattgcaaagaagataatctccgcgataacggcgatgttgatgatgattccgatggcatatgcgggcgcatcgatttcctgcaaaaagagataaccgtaattgtagtaagatgcatgtgccgcctgcagtaagataacgattgcgagcaccagaccgaaatatttaatgcggaataaggcaaacatgccctcttttcttgcacggtctgtttccggccgttttgaaagaacagctggcgcatgcataaagcttagggatgcgaatatcagggtgcccaaaagcagtgcccaaaagcagtgcccataaaatcgcttgatctccgaatatacctgtaaagacggacaggatgacgccggctgaaacaaaacccgcggatccccactgtcggctagtcccataagcctttaattcgttatgctgtacaaggacgccgcaagcgctgtctaaagcaggcattaaagccgggtaaaacacatgcagcactaatgtgacaagaagcaggctttgaaaagaatcagccggaatataacataaaagtgcgagaagcgtcccgattctggcgccgtttaataaggctttgctgctgaattttcctgataaataagggaagaaaaataatgtggaaatccctcttgccgccaggcccagactcataatgaaactggcttcggatacggaaaccccttttatatgcaccatccatcccgtccaatagggcagaaaaacaccccatgtcataaaaaaactaaaaaaatgcagactcatccagcgatatgctttcattcccgttcctcctttaattggcatgttatcatgtaaggacataaagacaatatgagatatctcatatttttggggtggacgatggaaatttataaaggcgagaaaaagcggcatcagttaaaaaaacactcaatcgcgcatttattctctttccccgctgaagagtttatggaagtgcgcgaatatgagcgggacgaatggattattcaagagggcaggagacctgacttcctgttttacgtgattgaaggaaaagcgaaaatatatgtaacccaccaaaacgggaaagtctctttaattaattttatcaacaaaaatgattacatcggagagatggaactattacatgaagggtattacacaaaaggaattcaagcctcagcgaagactgtttgttttgctctgcctatttaccgctgccgcgcgcaattgctgcaggatgcgaaattcctgcgtgagctggctaagtttttaagtgctaaggcaacgcttatggcttcgaaatattcacaaagtctggcgttcccgcttgaaaaccggcttgctgattttattttgcagacggcttataaaggggtttataaagagaagcacgtaacggtctgtgattatttgggtgtatcttaccgtcatctcttgcatgtgctgacgcaattctgccaaaaagggtatttgcaaaaagaagggcggggctatcaaatgaagcagtatgattcattgtacgaacttgcagaagcgctgcataataagtagcacgccagaaaaacagccatccgcaaattacggatggctgttttcattatacaagctgagcttgtttttttcgtgcctgtttcgcggcgtcgaccatattttttaatgccgcaacggtttcttcctgctgtcttgttttcagtccgcagtccgggtttacccagaagcggtcagtcggacacacttcaagcgcgtcatcaataatttgatagatttcttcagttgccggcacacgcgggctgtgaatgtcgtatacaccgagtccgaggcctttcacgtaaggatgttctttcaggtactctaaaaatcctccgtggcttctgctgtgttcgattgtaatgacatccgcgtcaagatcattgatcgtatctacgatatcttcaaagttgctgtaacacatatgcgtatgaatctgtgtctcgtttcgcacagaagatgtcgttaaccggaatgcttctgcggcccaagttaaatattcatcccaatcctgcgtttttaacggcagtccttcgcggagcgcgggttcatccacttggataatctgaataccggcatcttcaagcgcttttacttcttttctgagggcaagcccgatctggaaggcgatttcttttcttgaaatatccacacgcgggaatgaccagtttaagatggtgacaggtcccgtcagcatgcctttcatgtgtttttcagtcagcgattgggcgtagaccgtatcttttaccgtcatcggttcgataaattcgacatctccgaaaatgacaggcggacgtacgcagcgtgaaccgtaagactgcacccatgcatatttcgtaaaggcgaatccggccagtttttcaccgaagtattcgaccatgtccgtccgctcaaattctccgtgaacgagcacgtctaagccgatttcttcctgaatgtcaacccagcgcttcgtttccgcattaataaaggcttggtactgttcatccgtccaatcttttttgcgccatttttgccgtgcgctccgcacctcggcagattgagggaagcttccgattgtcgtcgtcggcagaagaggaagaccgagtgattcattttgcagcgccaatcgttcttcaaagcttgccggacgggagaaatctttttccgtcagctgattcagctcttctttttgagctgagttcgctcctgttgcgaatgcttttaaagccttaagtgccgcttttgattcttcgatctgctcactgacggccgcttttccggacagaagcccttcttttaagacgccgagttccgccagtttttctttagcgtatgacaggccgttcagcaaatccttttcaagatgctcgtcagggtgtttcgccaccggcacgtgcagaagactgcttgaaggctgaatccataactcctcaacatcagcgtggctgaggatatccaaagctgcatcaaggcgttcttcaacatcgattttccaaatgttccggccgtcgaccacaccggctgccagcactttatctttcgggaagccgtgctttttcaattgctcaaggtttctgcctttatcatgcacgaaatcaagtccgattccctgtacgggataagaaacgagttcttcatatgcatcaactgaatcaaagtatgtctgcaggaggacattcagtcctgaaagctcttttgtaatagattcatagaggtcttttgcggcgcggacatcttcagaagaagctgtcacaagggcaggctcatcaatctgaacccatttgacgccttctgcttcaagctctttcagcagctgcacataaagaggaacaaggcgtttttgaatcgctttcgcttctgattcttcgtatcctttcgcaagcgtgacgaatgtatacggaccgacgatgacaggtttcgtttccgctccgaattcttctttgatccggcggtagtcgtcaagctgtttgtttctcgtcagacggaattcaatgctttcatcatattcaggaacgatgtaatggtagttggtattgaaccatttcgtcatttcactggaaacggcgtcttttacaccgcgggcaatcgcaaagtatgtatcaacgggatccgtgatgctgcggaatctttccggaatccagttaaagctgacggcggtatcaagcacatgatcataatgagtgaaatcagagaccggcacgatatcgatatgttggtcaagctgtgttttgacagctgataagaataaaccgtcaagctttttaagaaacgtttctttatcagtgtttcctttccaataagcctcaagtgcttttttccattctctgttcaagccgattctcggaaaaccgaggttcgaagttttgattgttgtcattaagtctcctcctttaagtgagatgtaacaaaaaagcctctttctcatgagagaaagaggctttaacttcaaaatgcaagcctctcttatctctcagatcacgtctgatggaattagcaccgtgccttatgagacaatcgtctcggcgcaaaaatcacgcgccccatttcacaatggaattacggtcggttgctgttggggtcaaaaggccaatccctcgcccaactctcgataagagaaagtatttcaatttttttgaaaagttacatcatttgttggttatcttatcagcttattcagatcactgtcaatagaaaatctcacaatttaaaaattggtgatgtgacaaactgatcaatcattatacgagaaaaatatcagaaagacagcagctgtgcctgttcggctctttccatcagtacttcaggcgcgtctaaatacagaaatccgttcccggccaatgttttggcgatgtccaaaggaagggtccgccgcacgagctgggcgtagacttcagcctcagaaagcgtccgctgaaacgcgtcctgttcaagcccttttattaaggcaagcgctccgctcacatgcggggcggccattgaagtgcccgtcagcttcccgtatttatggttgggaagggtggagagaatattttctcccggagccaccaggtcaatctctttattagcgtttgaaaattcagacgatttacgggcgattgagactgatccgactgcgatcacttcgttgtaagcggccggatacgacagttcctctgtacgctcgtctccgtcgccttcgtttcctgccgcgcaaacgaccagaacaccgctttttaccgcatttgtgaccgcttctttcagttcaggcacatcgcttggcccgccgagtgacatggaaataatgtccgccttttgttcaacggcgtagttgatgccgttaataatccattcgtatttgccgctgccgtttttcccgccgagaactttaacgattaaaaggcttgcttccggcgcgacacccgaaattccgccgtttgaatcattggctgcaatcgttccggaaacgtgtgtcccgtgtccgttgtaatcggaaatcacgtcttctttgcctccgtcatcatcggtgaagtttttcccgccgacaatccggtctttcaaatcaggatgattgatgtcgcagcctgtgtcaagcaccgcgattttaatatccttgcctttaaacccttttgcccacaactctggcgccttaatcactttaatcccctcaggaagctcgttcacatccatgatctgttcatccgtgacataaggaatcaaatgcatttcaccattcataaaaaagccctccttttttatgcttgcgagtggatacaagggtgttgctactattttatggcagagcatgccggccggaaagagtcatttgaagcattttcataaaaaaggcgtaatctatcggactaaaaaatttcaaataaatggatagtttgacagctttcattttcattcatgacccgctgacgctataattggaaatgggaaaggagaagagagatgaagataaatgaagcgttatacagctatttttcagaacaagtggatcaaattgcgaaagagtggatcgaaacgatggaagattcggatccgaattcgatttattctttgacaaatcccgtcatcacagaagaactgacggagcaggataaagaattttaccggcatattaataaaatgtatatcatgccggaaaaagaatttttagaagagttcgagcggtgggtgattgagcttgcgaaagaccagaagcatctggatactcccgtccagtatgtggtccgtgaattcatgagaaaccggagactatacatcagttattatgatgcgtttgccgataaacatgaatcttcgtttgctcagggagaaaggaagaaatgggagaatttaattacgcaagtatttgattttacgatttacacgtttgtcgatcatgctgagcataactcaaaaatgcagctgaatgcgcaaagagaaatgattttggagttaagctcgccggttatcacgctgagcaaacggacggcgctgctgccgcttgtcggcgatattgacacggagcgcgccaaattcattcttgaaaatacgctgagcacatgtgcaaaacggctgattgaacatctgttaattgacctgtcgggtgtagtggttgtcgatacgatggtggcgcatcagatttttaaattaattgaggcgctgaaattgatcggcgtcacgtccactttatccggaatcaggccggaaatcgctcaaaccgccgtacagctcggcattaatttctcagatattacggtcaagtccaatctcgctcaggctctcaattatcatcaataacatacataacaaaacaggctgccgaatcactccggcggcctgtttttatataaacaacaatgaaatgagccagcttgccccgaataacagaagcacgagcaggaaaaagcaccagtcggcgcggcgcacagtaacagttctgtaaaacgtgcggtttcggctccccgtaaagcctttagattccatcgcgatcgccgtgcgttccgcctttctgattgcgcctgccaatagcggaatggtgaagcgcctgaaggcggagagcttccctttcagcccggaatcagacgccgcacccctgattctgtgcgcctgccggatgatcaggatttcatctttcagaagagggagaaaccggaatcccgcgataacgccgtatgcaagcttgggcggcagcttacactgctgaatcagactgagcatgaacagaatcggatcggttgtaaaaagaaacatcatcgacaaagcggaaaaacatagaatacgaaacgcgatagaaatcccgagcgccgcgttatcactgttgacggcaatcggcccgagcttaaacagcagattgcttccggttgtcgggacgtttccgaatacggcggctgtccataaagaaccgaaggccagaatgacaaacggaatcgtgaacagcagccattttttcagcggcacacgccccgccgagaggacgcctcccgcaatgatgatataaaacaaagcaggggtgtacggattataaataaatgacagcataatgacgcataacaatacagccgccgcctttattgacgggttaacagcctccagccgcaagttcatttctccgcctcctgtcgtgtttcatccattcataccgcagcggcaaagccaaatgtgcctgctcggcgatcccgatgttatcagaaaacaaagcgtcgggagttccccggaataccagtttcgtgccgcagagcacaaggatcgtgtcggcataatccgagacgagttccatatcgtgtgtcaccatcaaaacagccgttccttccttttgaatctcacggagcatttgcatacactcccgcgccgttttggcatcctgtccgaaagtcggttcatcaagcatcaaaacgttcacattgtgcataagcatcgtcgcgacgctgagccggcgtttttgtccttggcttaaagaaaacggatgctgtgaggcatggcgtctcaggccgaatcgggttaacagctgaagagctttctcctttgcggctctgttgctttcaaaactgaacatcagctcttgaatgacggaatctgtgacaaactggtgttcaggattctggaaaacatatccgatctgccgccgcagctctttttcagaataggaatcaatcggtctgccgtctattttgatgtctccgcccagcggacggatgagcttggccgcagcagaaaggagcgtggattttcctgttccgttagggccggcaatcgcggtgattgatcctttttttacggaaaagctcacatcctgaaaaatgacgtctgctcctcttgagaatgacagcccgtgaacgctcagcgcgtcttctgccgaaagcgcaacgggcctgggttcaggcagagatggtacaggttcgtgaaacagattttctttacacaatgtaaaaggaatgctgacgtgctcctgcaatgagatcacacgcggaatcggaatgccgagctgcatcagctcttcaatcttggtttcaaagataacatccgtctctccgtccatcaccttctgacccgtttcgtcaagcacaatcgtcctgtccatccacggcgcccagtgatcaagctgatgttcgataacgagaaggccgaagcctttttttgcttgaagatctttgatcagccgcactaattcacgtgcggaatatggatcaagctgtgccgtcggttcgtccaaaataatgagttccggttccattgcaatgatacaggcaagcgccactttttgttttgaaccgcctgacagcgaagcgatcgttcgcgttttcagatgagtgatctctaatttttctaaaacgtcatcgatgattgcgtccatatcttcttttgtatattgcaaattttccaggccgaaggcgatttcatcttcaaccgtcagcatgcaaaactgctggtccggatcttgaaacacgacgccgatggatctggcggcgggttctgtcagatgtgaaagaggtgttccgtataaagaaacggttcccgattgaaccccatcgcatgcttccgggtacagaccgtttaaacagagagcgagcgagcttttgccgcatccgctcggcccgagcaacaaagcccgctctcctttgcggagctgaaaggacacgttttgaaaaatcggcttttcatcctgatcataagaaaaggtaagacagctggccgatagaaggggttcagatgcctgcatcttggttcacctgtttctttttcttcttgaattgttttccgagcgccatgccgttcagcactcctgtgtaagccagcgcatcactgattgctttgccgagaaggccggcaagaagcgcacctgagaccagacggatgagaagcatgacggctaataaacccggattcaaaacagagtatccggaaacgaacaagtcataaatgaagcttgtcacagaagaccccataccggataaaagaagcacgggcagggtatacacccgccagcgtgtcgctaaaaagaccgcttccgcaccgattccctgtgcgatcccgatcagaatcaccatcggtcctgacggatttccgagtaagcactccacaaacgcggcgatgatttcagaaacgagagccgctcccggtttttgaataatgtacgcggcaatcaccgagacgataaaccagataccgtaaatcggttcataactcatccggccgaaaaatcctgccgctatattgcttgcatgagttgatactaaataaatgacagcaaatacaacactgatgacggacatgacgacaatttctctcattttccaatttttcattgtgatctcctgctttcttatcggatagttgtttgtatgaaagagttgattttacgaaagacgattgatcgtaagtttcatattgcggtgtcctcccccgttttttaatgaaaaataaaaaactgcatatccgagggaatatgcagcagcagaacgaaaacgcatggggaaaaaccctgcgctccggtcaatctgcacttccccacgctggtattatccagatcgggttataagggatcaaaacacgcttgccgcatgttttatctcagccgataacagcacccctagtgcgtttcctatacagttttttatgatgacatcatcatagttgatcatgtctgatttgtaaacagcctttctccgaacagagtttggaatcggaccggaggatcattcataaagataagaagaccccttttgatcaaaaggaaacggaggacatctatgtttgttcatacagtgcagtctggcgactcgttattttccatcagcagaaagtacggatatcctgttgacagcatcagaagcgtcaacgggcttgaggaaacgaatatcgtgccgggacaggcgcttttaatcccccttaatgaatatacggttcagccgaatgatacgtatgccgttatcgcaggtaaggcttatgtgccgcagatgcagctgatgcaggcaaacccggatattccgccgaaccggctgcggacgggtatgaaagtgaagatccctgatatctctaactatcttgcgggaaccctgcaattttatgtcattcggacgcctgaagcggatagagagctcattaatgattttgcaccctattcatcggcgatttctttgtttgaatatcatttcggcccgaacggagatatcatgaatgatttaaacgacagaaccgcaatagaaaccacatggcagaacagagtgcgcccgcttgccgtcattacgaatctgacagaagggggattcagtccggaattagcccatcaagtgctgcaaaatccggcggcaagaacgaatctcgtcaacaatatcgtctccttaaccgtaagaaaggggtacggcggtgtaaatatcgattttgaacgggtcagagaagctgacagggatctcttcacaggatttctccggcagttaaaaacccggctttcagagcatcagctcgcgttaacgatatcggttccggcgaaaacaagtgatgcagtgccgtggctgaggggatatgattacggcggaatcggagccgtcgtcgattacatgttcattatggcgtacgactggcaccacgccggcagtgagccgggacccgtggcacctttaacagaggtcaggcaaacgatcaattttgccatcagcagggtgccgagaagaaaagtgattctcggtgttccgctgtacgggtatgattgggtgattccgtaccgtccgggaacgatcggatccgccatctccaatcagcgcgccatggaaacggcgatgaagcatcaatcaatgatccgttattcccagcaggagcgttccccttacttccggtatactgatgaaaatggaagaacgcatgaagtgtggtttgaggatgtacggagcatgagtgaaaaaatggttctcgttcgggagttcggactgcaggcgatcggcgcgtggcaattaacgctcggtttcaaaccgggcccgtggctgcttaggaactttttcacgatccgaaaaatatagctgcatgtccttctccgcaagtgattttttctttcctatgataacggagcttcttttggacaatctaaaattgaaaaggaggtctgtcatatgaagaaaagggaagagcagtatatcaacgaggctgagtatgtaccgcacccgacgaaagaaggggaatacgcgctcatgctgcatgaatcctatcatttcctttcagaagaggatgaaagcgatttgccggaataagggttttatgcctttattccgtttattttataggcatgtgctgaaatcacaaatttaaggttgacacattccttttttttctgtaatctcagtgtgtcaattcaaataagaacttcgttaggtgaggctcctgtatggagatacgctgctgcccaaaaatgtccaaagacgccaatgggtcaacaggaatcatcgacataaggtgattcttaacgcagctggatggctgtcctatgccatacagtgctaaagctctacgattggaggccccgcacgtttatttgccgtgcttgttttcgccttcatatcggaaggttttttttatgcctcaaaacgtacacgactgagcatgataaggaggtgcggagtatggattctccccattcgagtatgtcagaagaagtacccatatacagccagataaccagtgacgacatgatgaggagacaaaccgccgcacttcccttgacggacggcgcgtctccgtaaaggaggtacgagtcccgatggtccaaaacatgacctatgacgaactcatattacgcattatcattttattgcgggacggaaaaataaaagaattccgaaacatgatagatgagcttcagccctatgacatggcatttttatttaaagaaatgccggaaaagcaccgggcccgctatctgtcatatatgacggttgatgacatcaccgacatgatcggagagctggagcgggaatttcagcttgccgttttgcataaagtcggtaaaacgaaagccactctcgcaatgaataaaatggataacgacgatctcgccgctttgctggaagagatggatgaagaactgaaagaacagcttttatccagcatggaggctgaggaatcaaaggccgtacagcttttgatgaactatccgcaagaatcggcgggccggatgatgacgaaccgcttcgtctggattccgcagcattatacagtaaaagatgcggtcgtgaagctgaaaagctttgcggaaatcgcagaatcaattaactacttgtacgtgattaatgacagcaagcagcttgtcggggtgctctcttacagagatttaattctcggcgagcctgacgataaagtgcaggatctcatgtttacgcgtgtcatctcggccggggtgctccaagaccaggaagaagtcgcccggctgatccagcggtatgactttttagccattcccatcgtggaagaaaataatgtgcttgtcggtattgtcactgtcgatgatattatcgacgtcgtgatcaaagaagccgatgaagattacgaaaaattcgcagcctccggtaaggcgattacatttgatacgaaagcatacgtggcggcgtacagacgtttgccgtggctcattctgcttttgtttatcggattgatttccggaagcattctgaattattttgaagatacattgcaaaaagtagtcgccctcgcgtttttcatgccgatgatcgcgggaacgacgggtaatacaggcacacagtcactcgccgtcgtcatcagaggactggctaaagaagaaatgaataaaaaaaccatctttaaactgattttccgtgaattaagaaccggtatctacatcggcatcgtctgtgcgatcgcgataacgattgtcgcaaccgtctggcagaaagacttaacgctcggttttgtcgtcggttcatcgctgcttgcaacgttgattatcggtacgatggccggaacgatcgtccctattattcttcataaactgaacattgacccggcgattgcgtcaggcccgctgattacgacactgaacgatattttgtccttattaatttatttcggcattgcaactgcatttcttcatgctttataaaaaaagtccgtctcacaggaggcggacttttttgatcagcggtttttatacttaaaatgagcattaagctgtccttccagcatttttttgcggagctgtgggtcgtttttgagagcctgttctttttttcgcatgtcttttaaaatctcggccgtctgcacgccgtcttcccgtttgttggcaatatccatcagccgctcaacgtccgcgaaggaatactttctcgttccccgtgatgatcgctgcgggtagattaatttccgttcttcatagtatctgatctgtctgactgacaatccggttaattcgcttacaatgccgatcgagattacttttttatctttgtaagattgttcgtctgtcgtcatttttccacccctggatgtcttttactcatattatataagaaaaaaagagaaaaaacctgacgcttgtcaggttttctgacgcggaatagaaaattttagaaaaaaagcggcagaaaaattgacaaggttaatgcatggtcctgtgccccgttttattctgtattatacagacacaatgaggaggaaggataggaatggagaaagaaaaagcggtttcactggcaaaagaaatcattgaattagatatgaaacgcgatgaaatgctggaggcgttcatgcagcttgccggggaacacgcttttccgctgctcagagccgtccagaacggtctttaccgaaaaacatcataatctacagaagttttacaatggctttatacatccttgatataaaagcgttattctgatcatagaataacggaaaacaaaggaggccgtcatgagtcgtttgcttcaaaatgcattggataaagagagaaaccattattccaaaaagcttctgcagatcggagtctatacgaaagaaatacttaattccatgacaattacggagctgagaaaggaatacgcgtatttttttcggaacattccctataaagaacggaacccttatacaaattaaatgatgtataagggtatttttttatataaaaaagaaggaattctgaaaaacggcacgaatagaatataaaacaaagaacgactcttatgaattgtaagggtttacattatttttttataaaaatcttaaatacggggtagatatgatgagattatcatttaacgaagaagaagtgatgcgttcgatgaatttgtacaaagtttttgcaagggctttcaagagtgtgtctgaacacagcatccgcgacagtaaagaacacggttttaatccgactgaatttgccgttttggagctgctctatacgagaggaccgcaaaagcttcagcaaatcgggtcgcgtcttttgcttgtcagcgggaatgtcacctatgtcatcgacaagcttgaaagaaacgggtttttggtcagagaacaagacccgaaggacaaacggtctgtttacgcccatttaactgataaaggaaacgagtatttggataaaatttatccgattcattcattgagaattgcgagagcgttttcaggacttatgcctgaggaacaggaacagctgatagccttactgaaaaaagcgggaattcacagccagcatttgcttttccgttaaaagaaagcggatacagacactcttcttcatgaagagtgtttttttctgtttcggacagtagagcctgacgcggtttttgcataagctgatacagggcggcatcattatttaccaatcataatgtgacatgccccatgccaaaatatgagggtgctttgaatataaagaaggtgaacatgtgagaagctgtctgctgtctatatggtacttacttgatccgctttatttcttctttacccggctgacgctgattgataaacggcaatcgaatgtattccgcgtccgtttgactagatataaaggaaaagaagtcatcctgagcgacggaaccagaattaaaaaaaacgacgtgttagttaagattcatcttcataatgtcaaactcctgaaagagctgcagcctattgaaagcgcggtcagaagggggattatgctatatcagaaggtatatcaatccatgcctcatttagcggattatattaaccggcataaacggaaagacgagattaagggagtcgtcggcattacaatgcttcataaaggagcggcgagactcggttttgatgtgataaaaccgtccagcggctgctacaggctgtttaagaaagcggcccatcttccgattttatactttactgcaaaacagctcaccctcaaaaacattccttactcctgctatttatttatttccaaagaaaaattgatgtgcacgtatcagactgaaaagagctgacaaaaagcgtcagctctttctcttgatttgctcaagcacgattgaaagcgggccgtcctgcggattccggtaaaaatcataaaacggatctccctctgtcctgacgcggttcactactgtatcgatcgtataatcatcaggtgttaaagaggagttgacttcgctccaataaaggggagccgcaaccgttcccaattcgttgccccgggtcgaatagggggcgataatggttttcccttcggcatgctgcaaataatctaggtagagcctgccgtttcggtttttgataaaccgctctgtcgtaaaaagatccgggcgcgtcctgacgcaataatcggcgatgagcattgtgaaggcacgggtttcttcataggtgaatgcttccggtgaaagcgggatgtagagctgaatgcctttatttccggagagcttcgggaatgacgtcatgctgaatgagtcaaacagctgtttcagcacatgcgcagcctctactgccatgggaaaatcattccttgacggaggatcaagatcaatgacgatttctgcgggcctttcagaatgaactttctgaaacggaacgtgaaattcaagcgccagctgattagccagccatagaagtgacggtatgctgctgcatacgatgtgctcgtggctcccgtcaaacacgcttgagacaaagtccggcgtgtagtccggtttgtttttttgaaaaaaagattcgccaggcgcgccgtgcggataacggatcaccgtgacggcccgatctttaagaaagggcatcagaaaatcgctcatttttaccatataactaaggaaatctgctttcgttttttcacgttttttaaaaacgatcttatccaggcttgtgaactgcagcttcggcggcagcgttttagagcggaggataagctgctgatacgtgcattccgtccaatccatttcaaactgaaaggacacaaaagatacttcacgcagcgtgtcctgcaatatggttaaatactgcacggtcatgcagatagaaggctcaagtgtatactcgccgcttttttgtttttttccgtgggtctccataatggttctgacggcgtttttttcttccgcctgcatgccgtgggaaacggaagcgatcgggacgacgatgccgtctttcaaaacagaggccgtcacatacccgttcttcggattgaatccggttaatagcacgtgagccgttttcatatgtttatacttctgccagtcgggagaccgtttattttccgaccagccgctggaagcccttttggctacgataccttctccgtcatggcggacgaccttgtcccaaagcgcattaaagtcagtgtgctccggaatgtattgaatcgcttcttccgctaagtgatgagggcaggcgggaagatttgcttctttaagcagcttggaaagggcgcgcttccgtttcacatacggtaatgagacggtgccggcgccttccagaacgaggagatcaaatgccagaaagcggcacggccgtctatcagcggtgctttcaattgcttccgtccgttttaaacgtccgcggatttgaagatgctcaaagtccgctctgtacggattgattaaatagacaagctctccgtcaagcgtaatggggaacctgtctttcatgtgctgaaaacaccgggccgcaaaagccgtgatttccggaaattgattcgtcagcgtctgtccgtttctgctggttaatgtaacaccgctttcgtctatgcggagaagacagcggaatccgtcatactttacctcatagcgccactcgctgccttcaggcggtacagaggtcaaaatcggctgcatcgtcagcaccatgattaagacgttccggctttttgtctggtcgtcttctgctttttgcctccgccgcctgctgacgctgtgtcttttgtccgtgccggtgcagcctgttcgcgattcggccgcttcgtccggtcgatgcttgcctgaagcgcgctgacaagatcaatgacatcttcgcgagggccggcaggagcaggtgtcacgcccgcttcttcatgttcgagcttatcgttaattttggcgagaagggctttccggtatgtgtcttcatattgttctgggtcaaactcggttgtcagctcattaattaacgtgatcgccgtctgcagctctttttcattaacggctgtctgctcaggaacgcccggcacatgtccggcatttctgacttcatccggataatgaatggattccatcacgatgcagttgtcatacacgcgaagaatcgcaagctgctgtttagagcggatcgtaatggaagcaatcccgattttacccgtcgtcctcagcgcttcccgcagaagtgtataggcttttgtaccgttgtctcccggcccgacataatatgaccggttaaaataaatcggatcgatttcctgcagctggacaaagtcaacaatctcaaccgctttttcttcatgttcctgttttacgtctttcaagtcttcgtcagtcataatgacgtatttcccttttacatactcatagcctttcacgatttcatcaggctccagactcttttcacatccggtgcagattttttcgtatttaatcggcgcatggtcttctttatgaagactgcggaattttatatctttatcttcagtggccgcaaagagcttgaccgggatattgacgaggccgaaactgatcgaacccttccacatcgtgtgcatgaataaaaactcctttttgtctttattgtggataaacgggtccgttccatgtgtagcaacttatgggtgatgcggcgcttcatggagctgctgttccatttcctcatgcggtaatggccggctgaaaaggaaatcgcattcttattcatctatttacaatcagtgaatcggtaagttctttaaagcgctgaagtccccgaaaatcatcaatggttgatcaaaaagattatacagaatcattccccgggaaatgcccacacatttccatgtagtgactgagagtttcccgctcccataaaacagattcggtggcaaagatcccggcaaaaacgcattgcccatatgaactgaattcgcggtcagccgccgcttaccgcgaagggtaacttttccggagatcttaagtgatgtaaccgccgccagacgagcaatcaggagacaggcgggacgttgtattgcgcatgtcattccctcccgctataccgatctgaaacgactcacatttataacgggcatgtctaaaagatatttcagcctcaaggttttgtgttaaaatcattcttaaatttcagaatataggtgtaagccgggagtgatagatcatcgaagatttcatcatatcaataattgaagcgtttaaaagcttatcttacgccggaatttttttggcgctcagtatagaattcatcccggcggaaattgttcttccgcttgcgggctattgggtctcaaaaggggatatgacgcttgccggtgccgtgtttgccggttcactcggcggtgtttcaggtccgcttgtcttatatgggatcggcaggctgggcggtcggccgtttttgctgaaatatggaaagtatatatggataaaacccgaatccctggagaaaacagatgatttctttcagaagcacggaggtttggtagcgttcatcggccgttttataccgggggtcaggacgctgatttctttgccgtgcggcattgcaaagatgaatatctgggtgttctctctctatacatatgcagcgatgctgccgattacatttgcttacgtatacctcggaatgaaactcggggaaaattggaaaagcgtcggttccattctcgatcaatatatgctgccgctaggtatattcattgtgttgcttctcgttctttggatgttatggaagagaagaaaacagcggatcaaaacagaaaaaatttctcaatttgttaaaaaagttaagcgttgacaaatgatgaaacaggctttattatgagcgtataaacaaatatttcttgaaatcccaaaggggagtagcgtccggatattccggaaacaaagtcgtcaattcatggatcatatccatcggctttgttggcatgccaatcattcatgtctagcaagacctttgccttatatcggcaaaggtcttttttgcgtaaaaaaaccgccggtataagctcggatgatagaaaaaagaaacggagggaatggattggactttgcattattattggagtatggatgggtttttctcgttttaatcgggctggaagggattttggcggcggataacgcgctggtgatggctgtgatggtgaagcatcttcctgaaaaacaaaggaagaaggctttattttacggattggcgggcgcatttattttgcgtttcgggtcgctgttcgctatttcttttctggtgaatgtttggcaggtccaggccatcggcgctttatatctgttttacattgcggtcagccatttgctgaagcggtatgtatttaaagataacgccggtcagaaaaagcagaaagaaagcgggttttggcagactgtcttgaaagtggagctcgcggacatcgcttttgccgttgactccattttagcggcggtcgcgcttgccgtaacgcttccgggaacacggcttcctgccatcggcggtttggacggcggtcagtttctcgttattttagccggcggcgtaatcggtttaatcattatgcgttttgcggcatcaatgttcgtatccttactgaaaaccaggccgggccttgaaacggcggcatttgtgattgtcggatgggtaggcgtgaagctcgctctttatacgttggcccatgaggaactcggtataattccggcagatgtcatccattcggcggcctggaaaatcattttctgggcggttctggctgccattgcggtttgcggatggtttatgtcaggagcaaaacaaacagagtccggcgcggcatcggaaaaaagagaacacgcgtaaaatgatcaaaaagggagtctggctttttaaaaagcaggttcccttttttgtttgaaacgcttacatttaagacatatgataacaattttataacagcattgttacaaaaaacacagagaaaacccccttaattctgcatgggggcacgaaatcatgtatagtacgtcttattggcttgtcataattgagacaaatgaaatcgatttctctttttcttcctttgcgaatccctactaaattagctatgattatgagtagttatagggaggaactgaggtgaaaccagtgcttagccttttgtttaaattgggaaaaaagaagcaaacgcttgaaacatctgttgaaaaaatacaaaaaggcgacaaagatctgcagaacgatttaatacagcaatataagccttttatcgcgaagacggtttcatccgtttgtaaacgatatatagatgaaaaagacgacgaattcagcatcgggctgatcgcgtttaacgaagccattgaaaagtattcggctgaaaaaggtaattcgctgcttgcatttgcagagctgattataaaaagaaaagtgatagactatatcagaaaagaagcaagaaccgctcagcatatcaatatggatgtgcaggaaggcgacgaccaggaatcttcgcagagccttatcgaagcggagctttccattgatgaataccgcaaacagatagagcaggaacagcgccgggaagaaattcttttttttcagaagcagctgaaagaatacggcctgtcttttaaagagctgctggaacaatcgccgaagcatacagatgcgaggcagaatgcgattaaggtagcctacacgcttgttgaaaatgaagagctggcgtccattttgcaccagaaaaaacagcttcctgtcaaacagctggagcagctcgtctcggtcagcagaaaaacgatcgaacggaaccgaaaatatatcatcgccatgagtattattattacaggtgattatatttatttaaaagattatcttaaaggggtgttgcactcatgagaagagggatcatagtagagaaaaataaaaaattcgtcacgttgctaacccctgacggacaatttttaaaaacaaaaaatgatcaccgcacttgtgaaatcggagaggaaattacgttcgaaggcgaaacgcgtatgggaagaagggccagcttttttgattttctgaaactgcgcccttttaaattgggagtgtttacgatgactgctattattttgtttattttaattttactcccggttttttctgataacaaagcttacgcgtatatgacgcttgacattaatcccagcattgaaatggctttaaacagcaaatatgaagtcattgaactgacaccgctgaaccatgacgccaaacaggtcatcagtgacatcggagattggaaaagcagcgattttaaggaagtcatcagtaatattattaccgattgcagcaagcatggatatgtaaaggaatcaaaagagattttaatttccacggtttatgaaaatacagatgacaatacatataaaaaaggcgttaaaaaacagctggctgacatgactgaaaaatataagggcacctaccaggtccaatcgcttgaatctgatatggaaacaagagaaaaagcaaaacaggaagggatgtcaacaggcagctacataagaagaaacgaaaagaaaacagaagaaaaacagtctgaaaagcaaaccgacggcaatgaaacagatcagaaagataccgaaacagacgctgatcaaagcaagcagccggacacagaaaagccggcggctgatgaaaagacagctcctgatgaagaaaaggcagcagagaagccggaaaacaatgaaacagcgcccggcacggaagaagcgaagccggacagtcaggacggcagtcagcaaaccgacaaaaatgcagcttccggatcagaagaaaacacacagaaggaacaagatggggaaacagagcagcccccaacacaaaatcctcaggaaaacggaaatgacaaagagcctaagcaaaagtattacaatcattactggaatcagcggaatcatgatcgcaatgaacattgggactcctatcggcatcatgaagattcgtcagaccgcaggaatccgaacggctaccggcacggaaaggagaatgccgataaatatcaaaattcgccgagaagtcccggcgaataagctgcattattgatttttcccgtttaattgtgattgagcctgctgtacaagacgttttgtcatttccccgcctacagagccgtttgcgcgtgctgctgtatcagagctaaggttcacgccgaattcttgagccacttcgtatttaaattggtcaagtgcctgctcagcccctggaactaagagtttatttctgctcgccatctttttcatctccttttctctggcaagatgtgtttacgcattttagtttcaaacggaacggtattgattatgctggcaattgttgtacagcaaaaaaaccccggcgcagacaccggggcgaagaagcgttatgaattataataaatggctggtcattttgtaggctgaggcttgaatatggaaagtcaaaacggagagcaccgtgaccgcgatgatggatctgatatcgttccattgtccgcttccgagttctttaaagcagcctttgagcttgtccgtctgctcttcaacgagctcctgcaggctcgtttccttcatcggcgggtttgccttatgatgaagataatcaatcacttgggcgcagctttcatagtagctgatcgggctgatgacgtcgtctgatctgtctgtgatcgtgttaaaagcgatttttaatatgccgcgtatatgttcgaagtcataaattgattttaaatcacgtacaatgagaaggatgacagcttgttcaattgtatattttttgccgagtaaggggtggccgattaaatctttaatatcgcgcttcacccagttttggacggcggttgattttaaagacgtcagctcgcacagatttcccagctcgacaatctcgttagttgaaagcccgtattcctttttctctttttttcgttcgaatctcgtcagaaattcagggatatgcagacggctttccgcttcatccaatgtcatatccgctgattgcaataagatttggagaggagttgcgtctccttggccttttaacgcgtaaagaagccggaccatatcagttcgggtcagtttaaacgtgttcatggttcacctctgattgattacgtgttcactttctaatattactgagaattacattaacatcatacgtcgaaattgttgcattttcaaacagatcatttataatttaattaaataagttcttttgatcttaaaaaagacggaggtaattatggcgaaaagaatatttctgtttattttaacgaaccttttggtcattacgacaatcggaattgtgcttacgattattacaagcgttaccggtgtcggctcgtatatacaaaatggccgcattgatctgatggcattgctcgtgttcagtcttgtcgtcggttttgtcggttcttttatttctctcggaatgtcaagatggatggccaaaacgatgatgggcgtccgggtactaaatccgaagaaacagtcactcagctatgaagaacagcaattggttgaccgtgtgcacagattgtcccgtgccgcagggatgacgaaaatgcctgaagtcggcatttatcattccccggaagtcaatgcttttgcgaccggaccttctaagcgccgttcgcttgtcgcggtttcttcaggtttattgcagcagatggatgatgctgcggtggaaggggttcttgcccatgaagtcgcacacatcacaaacggtgatatggtcacgatgacgctgctgcagggaatcgtcaatacgttcgtcgtattcctttcccgaatcgcggcatgggttgcaagccgctttgtcaaagaagacctcgcaccggtcgtgcattttatcgcgatgatcgtgtttcagattatcttttccattctcggcagtcttgtcgtcttcgcctactcgcgccacagagagtttcacgctgaccgcggcggtgcagaccttgccggcaaggataaaatgattcacgccctgcgtacgctgaagtcttatacaggacatgtgaatgaagaagaccagacggcagtgcagacgttaaaaattaacggcaaaaagcattcgtcactgttctccacacaccctgatctcgatgagcgtatccgcaggctggaagcaaaataataaacaaaacctctgacaatcgtttcagaggtttttttgtttaaagatcggcaaattacataaggtaatgaaaaatctttctaaaaagacctttaaaaattctcccaatatcattagaataattacgtactacatttgagaggcagaaggaactatcttatgaaattaaaactgaaaaaattcatacagatcttgtcgcctgcacagctgattgcattatattattttcttgctgtgacggtggcatttattttgctaagtctgccggccgcccacaaacaaggggccagctggtcgtttatagacgcgctgtttacggctgtcagctcagtcagtgtcaccggtttaacggtcgtcaacacggctgatacattcagcacggccgggattgtcattttggctttcgtgcttcaattcggcggaatcggcattatgacgctcggaacattcgtctggctcattatgggcaaacggatcggtctgcgggaacggaagctcattatggtggatcagaatcaatcgcagttttccggtatcgtcaacctgatgaaacaagtgctgtttttgattttattaatcgagtttttaggcggcatcatcttaggaacatattttttaacgtattatgattcgtttgaacaggcgtacttgcacggattctttgcgagcgtcagcgccacgacaaacggcggttttgatattacgggaaattcactcgtcccgttcagacatgactatttcgtgcagtttattacgatgcttctgattattttcggtgcgatcggttttccggtgctcgtagaagtaaaagactttttgttttcaaaacagcgcagatactcattcacgctgtttacgaaaattacgaccgttacgttcggaatgctcgttttgttcggagccgtgggcatttacgcgcttgaaggaagccatgttatgaaggggaaaagctggcatgatgttttatttttatgtctctttcaatcaaccgctacacgaagcggcgggcttgcaacaattgatatcagccagctgtcggcgccgacattatttttcatctgtgccctcatgtttatcggcgcatcaccgagctcggtcggcggcggaatccgtacgacgacgtttgcgcttaaccttcttgctctgtttcattttgccagagggaataaagcggtcaaggtctttaaacgcgagcttcatcaggctgatgtcatgaagtcgctggtcgttacgatgatggcgattctgctcgtgttcgggtcgacgctgattctttccgtgacggagacaaatcagacgctgctcgggctgctttttgaagtgtgttccgctttcggaacgaccggcctgtcgctcgggattactccgcatttaagcgacatcggaaaatgtgtgatcatgattgtgatgtttatcggccggatcggcattttgacgttcctttatttgatcggacgaaaagaaatcgaagcaaattatcattatccgaaggaaagaataattatcggctgacaccgcttttcagaaagcggtgtttttttattgccgtaaaatggatgagtggaaacagtttctttggagattctacttgtaaagaggtgacgtcattgtttgccgtattttggaagtcggtagttatgatagcggtcggtacctttttattgcggatcgccggacggaaatcaatcagccagctgtcggtgacccaaacagtcatcatgatttcgatcggctcgattattattcagccgtttattgaacataatttatgggaaaccattttcgcggcggcgatttttattgcggtactgatcctgatggaatatttagaaatcaaatcaagcttttttgagtttttattttcaggaaaaaccgtcgccgttgtcagaaacggaaaaatcatcccggaaaacttaaaaaaaatgcgttttaccgaagaccagctgtcaatgaggatcaggcaggaaggcctcggagacattcaagattttaaatatgtgctgcttgagccgaacggacagatcggctatgaactcattgatgaggccaaacacgtgacagtgcgcgactttaaaaaaatgcttaatgaattcaaaacagatttgctgacagaaggaggaaatcaaatgaaacgcaaagcagcaaagaatgaagctttgaccaacaacaacacaccgactgagagcatggacaaagatgcatacaaaacacaatacgacggtgatcccggactgagaggcgcaaaccgcaaatcaaaacacggcaaacaaggaggcgagtaacatgacgaaaaaaaaccgccacagcaaagacatgcaaaaccataaaaagccgatggaccctaaattgcttgaagaagagttttcaagcgagctcggtgattataacgccggaaaatggattgaaacgcttgaacagacgaagccgaagaaaaaagaagacggcaaaaaataaaaaatacctcttaagcgataacgcttaagaggtattttattatttcgaataagcaccgtttcttgttcctttcaccgcttcaagcaagcctgttatccgcagctcaataaacggctgtgcagccgttttcaccgcattgctggagagaatggacgtaagagcggccgttaacattaagagtatgactaaattctgataatcagacaagtgatcttcaagcccgatctgccgcagcatttttataatgaatccatgcagcagatacacgtaaaacgttctcgtaccccatttcgtaaagaaataacgcttttgcggaacgagcgccaaaaagctgaaagtggcggcaaaggccaaaacataccagccgatccgtgacagaccgctcaacagcgacactgtgccgaatgtagaataaggctccgatccgaacagccacgagtaatcaaaatcaatgcaccagcataagaggaaaacaatccccagtacgcccgcggcaatctgcctgccccttttagcccgaagtaaatcaaagtgctgttttttcaaataaaacccgacgaggaacatcggaagaaagacaaacgtccgtgaaagactcagcgtgctgctgataaaatcaagatacccaatcatgacggcaagcccgcagctcacaccaagcgcccacattttcggcagcttcgtaaagggataaagcagcagattccaaaagaataagctgactaaaaaccagagagaccattgcggatcaatcggattgacgcttgtcatgctttcatcctgaatcaagtagtaaaaaaccgagtaaatgccctgaaaaatcaggtacggaataatcagcttcacagccagcttcttcacataacctttccgcttaaagttttttgcgaaatagccggaaaccaggataaaggccggcatatgaaaagtataaatgaatttgtagagatggagcataaactcatttccgttaataaatgaccggaggatatggccgaacactaccagaaaaatcaagataaacttggcgttgtcaaagtaactgtctcgcgattttgtcatagcatcaccttctcttcaaaaatcatccactgcatgattatttcctgttggtgttcattttaaaataaaaaacaaaaaattgaaggaggaaaaaagggattgttaggatgatgtaacggggaggtaaggatcgtagaaaaagactttaacttgtcatatcattgaaattttctgaaatgtatagggcgattgaaggaagatgaggtattttgtagaaatattgaaggataggtttttgaagaaggagtgtactgaatggctgaaactctggatttgcaaacaaacgagtcgctgaaagagcagctgaagcggatgaaagaggaaaatgaccgcctgaagagtgaattgaaccggtatcatgtgattatgaataacacgcttgatgccatttttatatgccgtaaggaaatgaaaatcgtccaggcgaacgaggctgcggcccggatgatgcagattgaggcagagagccttattaaccgctccgtcctggactttttatattccgtgcctcaggaagaactgaataaggccgtgaaaaggtttttaaaaaaaggccatctgtggaaagaggtgccgattaagcttgacagcggcgcgacgaaatacattgaattcctcgccagagacggaattggggaggattatttttttgtggtgatgagggacatctcctctaaaaaaatattagagcgcgaattctccatgaacgagcagctgtttaaagatttgtttgacagggctgtcgacggcatcgtgctgtttgataaggacggcgggtttattgatgcgaacctctctttttgcaaaagctttgagatcggccagaatgaattgtcccatctgtcgctccgccattttaccgacggagaaaacaaaaagcatctgaaagaaatctgggaaaccctccgcagaaaaggaaacgccaaaggagaactgcccgtcaagcttcggtccggcgaagagaagctgtttgaatttacgattacgtccaacttaatcagcgggttctacatgtccattatgagagacataacagagaaacggttgatggaattgaaactctttaaaagcgaagagcgattccgcgaaatttttgaaaacgccatggacgcgattgtcatttggtctgatgacggaaagattgccaaagcaaacgaatcggcgtgccgcattttcgaactgccgatggataagctggtggagacgaatttatgtacgtttatcgttgatccgcagaaaaaatacaagcagattaagaagaaatatgaaaaatacggggaaatccgtgaagagatgctgtttcagatggcaaacggccaatttaaagagcttgagttcacatcaaaacgaaccatacttgaaggtcagcatttaaccattttaagaaatgtcagcgatcgtaagcggatggaaaaagaattgcgggaaagcgagctgaaattcagaaaagtattcaacggctcaatggacggcaaggtcttatttgacaaccaattccgtattattgacgcgaatcctctcgcaagccgtatactcggcatgccggatgaggagctgagagcgtacaccgttccggatattctttctttatttgatattgaaaacgcgggtgttcccgccagaaagattgatttagaaggaatggataatgaaatccccttcctgttaagcagcagtgacagccgcaaactggaattctccttcaaaagaaatatcattcaaaatatgaatctggccatctttaaagatgtcacagaggccaaagagcttgaagagaggctgcggaaatccgacactcttcatgttgtaggggagctggcggcgggcatcgcccacgaaatcagaaacccgatgacggcgctgaaagggttcattcagcttcttcaaggaagcattgaaggcgaatattctctgtactttaacgtcattacctcagaattaaaacgcatcgagtctatcatcactgaatttttaattttagcgaaacctcaggcgatattatatgaagaaaaagacgtgacgcagattatgaaagacacggctgatcttttgaatgcccaggccaatcttgtcaatgtgcagattcatctgaacctgaccggaaacatcccgccgatttactgtgaaccgaatcaattaaaacaggtgtttatcaatattttaaaaaacgccattgaagtcatgccgggcggcggcaatatctatgtgaccatccagccttctgatcaagaccacattttgatttcttttcaagatgaaggaacaggtatttccgaagacaaattaaaacgtctgggcgagccattttacacgacaaaagacaggggaacgggcctcggtctgatggtcagctataaaatcatcgaagaacatcagggacgcattcatgtggaaagtgaagaagggaagggcacggtttttcatttgacgcttccgatccggcagaataccgaagaaagaaggagcggggaatgatctgttttacaagtgtaaaagcgccgtttggaaccgttatcgtaacagaggaagagggctttattaccggcctgtttctcaccggggaagattttcaggaatggcaaaaagacgcgcccggcgtaaagccgtgcgaaaccgctttgctgtcggaggcgaaacagcagctggcatcatatttttcaggagaaagaaagcaattctctctgcctctgagacaaaaaggcacaccctttcaggaaagggtatggaacgcgctgacgatgattccttacggagaatcccgaagctacggcgatatggctgaagcgatcggaaaaccgaaagcggtgcgcgccatcggacaagccaataaacgaaaccggctgccgatttttgtcccgtgccatcgggtaatcggcaaaaacagcgccttaacgggatacgcgggcacgaagacggatgtaaaagcggtgctgctgaacatcgaacaaatatcctataaagaaaaataaaacatatggcacgttccgtattttcgcgtccgacatatcattttattaagtgaaaaaagttggtctgatgaaaaaggaggacgaagcctgatgaaaatgagccgtccgcaaaagatagccggttatgcagagctgttttttaaaatgcatctgatttcagctgcccaaaaagatgaagtgattacattatgcagacaaaaaaaccgctgacattgcctgaggcaacatcatcagcggtttttcagctcagctggcagtcagcgaataattgttcaatttcttccgtgtaagaaccggtcacaattcctttctcggtgataatgcctgaaatcaggctgcccggtgtgatgtcaaaggccggattgaagaccggcacatcttcgggagcggtgcgtatgcctgagatctgtctgacttcatccggatctctttcttcaatcggaatctgatcgccgttttcaatctgcaagtcaaaggtcgaaagcggtgcggccacaaaaaacggaatctgaaaggcgtttgccaaaatagcgaggccgtacgttccgattttgttggccgtatctccgtttttagcaattctgtcagcgccgacaatgactgctgaaatatgtttttccttcattgtatgggcggccatgctgtccgtaatgagtgtgacatcaattccgccctgcatcagctcccacgccgtcagccgtgatccttggagaacgggtcttgtttcacatgcgtagatatgaaggccgaggtctttttgtttcgctaagtaaaagggagcaagcgccgtaccgtaccggcttgtagcaatcgagcccgcattgcagatggtcatgatctggtcgccttttttaaaaaggtgcagcgcattttggccgatcattcggcaggtttcttcatcctcaatctgaatttgaatggcttcatgaacgagcgttgtcttcgcttcattgattgagattgcatccctgatggaatccgtcagtctgtcaagcgcccacgcgaggttgacggcagtgggcctcgaactgtttaaatacgctttgacatccgcgaactgacgtcggaaatctgaaaggtcgcgggcttcaaacgacttggcggagagcgcgagtccgaatgccgcggttataccgatggccggggcgccccttactttcagcgtgacaatcgcgtcgaatacatcttcctttgtttcaagttccacatattcagtgacgtcgggaagcttttgctgatttaaaatgcggatgtaggtttctttccattccacagaacgggggatggcaaattcattggtcatgctgcatcattcctttacacggagcttaaattgggccagaacttcggtgatatgcttcagttcttttctgttttcgatataataggcgccgatctcaagcgccagcttcttccgttcgattcgtttgtcaaacggagtgatttcatctaagtcagccacatgggcgagtccgatcgtgcgccggatcaattcgcatcccgcaaaaccgaccgcttcttcaaacgcgtttttcagtgtgtcttccagcaggtgtctgcgggaaggcaggcagtctttctcccatgcttcactgaatgttttcacaaatgtatcccatacggcggcagtatggtcatataacggctgtctgtcgtcaccgtcgcggctgagggcgtttaacagcagattggcgataaattggccgatgtcaaacccgatcggtccgaagaaagcaaactcgggatcaatcacctttgtttcatgttcatcggcgaagatgcttcccgtgtgcagatcgccgtgaaccaatgtttccgcggaattcagaaagatggctttcaattcgtcagcgccttctttcagccgggaattgttccaaactttttctgcgtatgggcgcagctcctcttcaaaatcgtttgtctcatggtcgagaaacggttctgtaaacacaagcctttctgtaatattgcaaagctcaggatttgtaaactgctttgcgagctgctgctttactttcgcatcgagcgcataatcggatgagtaaaaaagcgttttccctaaaaattcaccgatatgaaccgataagttcggataatgctgcccttccagcagcccttttcttgaaatctgcaaatgtgagaggtcttccattaccgtgacggccatttcagtatcggaatagtaaacggccggaacgaggtgcggcacgtgttcgccctggcggatgagggcgctgctttcgattctcgcccgatcaattgtaagcggccagctttcaccgacgactttcgcgtaaggaatcgcctgtttgataatcagtcctttttggttttctttatcgtaaacatggaagacgtaatttaaattgccgtcgccgatttcacggcatgtcagagtgcttttgctttggaataagccgagcttgacagctaacgcggcggcggagctttctgttaattgttcataaagacttgttttagttgctgacatggatttaccctccaattatgtagtggtagtaagagatcgtgacggagaatacgcccgaaaaaaaagcctccttctctgaaagagaaggaggctgaaacagtgcagtccgcctcttatctctcagataacatctgatggaattagcaccgtgccttatgagacaatcgtctcggcgcaaaatgtacgcgccccatttcacaatggaattacggtcggttgctgttggggtcaaaaggccaattccctcgcccaactctcgataagagaaaatatattgatttgtatcacaattcggattaatcagttgatgaaaatattagcaggtgccggatattcttgtcaacgtttttttgaaaattaatataaatcacgccgcaagtcttggaaaaccggaatggttccgcggacggccgcgctttctgacacatcaatttccgcccggactgagccttccgtccggtctccttcggctaaaatccggccccacgggtcaataatcaggctgtggccggcaaattcattatcgggattggaccccgtgcagttagaggctgcgacaaaacattggttttcaattgctctggcgataagcaggcttcgccaatgatcaaggcggggcagaggccattccgcagagataaacaggacattcgcgccctgggacgtatgctttctgatccattcggggaaacggatatcatagcagatcagcccggcgcacttgacaccgtcaagctcaaaggaaccgtcgctgtttcctgctgacaagtaaaggtgttcatccatcagctgaaacagatgggctttctgataccgcttcacgatctgtccgctgttatcggcgatgtacatggtgttatagacatcttcgccttctttgaccgcaaaagatccggcaacgaggtgtacgttgtatgtttttgccgtttctttaagccactgtttcgaaactttgccgttttcatccgccagctggtctagccgtgtgagatcatagccggtcgtccacaactcaggaagcacgattacatccgcatggcggctttcttgctcaatcaaagattctgcttttttaaaattttctgaaggatttccgtatgaaatatcaaattgcaaacaggaaacggtccatttcattttttaacacctcaagtttctctttactttttttatttaaccatatatgatgatggactatcatttcaagacatttttagaaggtgaaaaatatgaactttgaaatctcagatgtactcaaacagctgccggaacaatttttcgcatcattggtgcaaaaagtgaatcaaaagctgaaagaaggcagagacgtcatcaatttagggcagggaaaccctgatcagccgacgcctcagcatatcgttgaagaaatgaagcgtgccgtcgaaaggccggaaaatcataaatactcctcattccggggcgcttacagcttcaaaaaagcagccgctgcattttatgaaagggagtacggggtcacgcttgatccggaaacggaagtcgccgtgctgttcggaggcaaggcgggacttgttgagcttccgcaatgtcttttaaacccgggagataccattctggtgcctgatcccggatatcctgattactggtcgggcgtcgcccttgcgaaagcgaaaatggaaatgatgccgctgacggaagaaagagggtttctccctgattacagcgtaattcctgaaaaggtgcggagcgaggcgaagatgctgtatctcaattatccgaataatccgaccggcgctgtggcgacagaggcgttttttgaggagacggtcggttttgcggaacaaaacggcatttgtgtcgttcatgatttcgcttacggagccgtcggttttgacgggcataaaccgctgagctttttgcagacggaaggcgcaaaagagaccggaatcgaaatctataccttgtccaaaacgtataatatggcgggctggcgggtcggatttgccgtcggaaacgcttctgttatcgaagcgatcaacctttatcaggatcatatgtttgtcagcctgtttcccgcggcgcagcaggcggcggcagccgctcttttagcggatcaggcatgcgtcgcagcgcaaaatgacagatatgaatcgagacgcaatgcatggattgaagcctgccgcggtatcggctgggatgtgacggctccggcgggctccttttttgcatggctccctgtgcccgacggttatacgtcacagtcgttttcagatctgctgctcgagaaagcggatgtcgccgtcgctgccggaaacgggttcggaaaatggggggaaggctatataagagtcggtcttctgacaagtgaagaaagacttaaagaagctgcggaacggatcgggaaactgaatcttttcacctgaaaaagcattgacatatcaggataacaatgcgataattcaaaatactttataaaatcattattcttatcaagagcaggcagagggacgagcccgatgaagcccggcaaccgactgataaagcacggtgctaattcttgcagcaggagctgagagataagattcggacataacacgaagcctctttctgctcatacggaagaggtttttttatgttttgtgaaagaaagagaggcgttcacgcatgagcgaagtattggcaacatatcttctgacagacacaacggacagtgaaaagcgggcggaacagattgcggcgggactgacggtaggctcctggactgacctgcccctggtgaagcaggaacagctcagaaaacataaaggccgggtcgtaaaagttgaggagaaagaaggaacctcagaaaacgaaacacaatccgtcatcaccatcgcctatcctgaggcgaacttttcaagagatattccggccgtcctgacgacggtattcggaaagctgtcactggacggaaaaataaaattgactgatcttgaattttccgaagggtttaaacgctcccttcccgggccgaaattcggtatatacggcatccgcaaactgctgggcgaatttgaaagaccgcttctgatgagcatatttaaaggcgtgatcggacgggatctcgccgacattaaagagcagctcagacagcaggcgctcggcggcgtggatctgattaaagatgacgaaattttctttgaaaatgaactggctccgtttgaaacccgcattatcgcaggaaaacaagtcctgaaggaaacccgggaggagacggggcataaaacgctgtatgccgtaaaccttacgggaaggaccgctgaactgcgggataaagcgaggcgcgcggcagaactcggggcggacgcgcttttattgaatgtgttcgcttacggtttagatgtgatgcagagccttgccgaagacagggaaatcccgcttccgatcatggcgcatccggcagtcagcggcgcgttcacatcatctcccgtttacggcttgtcgcatgcgcttttgctcggcaagctgaaccgctattgcggcgctgatttcagcttatttccgtcaccttacggatccgttgctcttccgaaggagtccgcgcttgcaatccatgatgaatgtgtaaaagacgatgtctttcatccgtcgtttgccgtcccgtcagcaggcattcaccccggtatggtgccattgttgatgcgcgatttcggtatcgatcacatcatcaatgccggcggtggcattcacggccatccgaaaggagccgagggcggcggaaaagcgttccgcgccatcattgatgcggtgcttgaagcgcagccgattgaagaaaaagccgcgtcgtgcaaagatcttcagctcgcattagacaaatggggaagggtggaagccgtatgacccgcacaccgctgattatttgtgatttcgacggcacggtcaccatgaacgacaacattgtcagcatgatgaaagaattcgcgcctcctgagtggcttgaattaaaagacggtgttctgtctaaaagcatatcaatccaagaaggggtcggccggatgttcggactgctgccgagcagcttaaaagaagaactgaccggctttattctgaaggatgcgaaaatacgggacggctttttggattttgtctcgtttgtccggtcaaacggcctcccgttttatatcgtaagcggaggaatggacttttttgtgcatccgcttttggaagggatcgtagaaaaggagctgattttctgcaatcatgcatcctttgacaatgaatatattcatatagactggccgcacgcctgtgacggaggctgcaccaatcaatgcggctgctgcaaaccgtcagtcatccggaagctgtccgatcagcagaaatttctcattatgatcggtgattcggtcacggatgtcgaggctgcaaagttatccgatatgtgttttgcgagagattatcttttgactgaatgcaaagaactcggcctccggcatttgccttttcaagattttcatgaggtgagaacaggcattgaaaacatcggggaggtgcaggcatggctgcaaaagaagaacgctggcgagaacttgccgaggtaaagcgcgagctggccgaaagagactggttcccggcaacgagcgggaatctttccatcaaagtatccgacgcgccgctgactttcctcgttacggcgagcggaaaagacaaacgaaaagaaacagacgaagattttctcttaatcgatgagaacgggaagcccgctgagaccggccattctttaaaaccttcagcggaaacgcttctccatacttacttataccaaaagacagacgcgggctgctgtctgcatgtccataccgtcaataataatgtcatctcagagctttacggggatgaaaaacaaatcacttttcaggggcaggagatgattaaggcgctcggattatgggaggaaaacgcgtccgtgaccgttccgatcattgacaacccggcgcacatcccggcattggccgaaagcttcgcgcaccatgcggacgccggctcaggcgcggtgttaatccgcaatcacggcattacggcatgggggcggaccgcatttgaagcgaaaagggtgctggaagcctatgaatttttattcagctgccacctcaagcttctgtcactgcggccgcagcttgtaaaataaaaggaggaatagaaaatggcgaccatcagaattcatgacgaaaagaatacgctcattgaaaaacaggaagaagtagcgcgcttcttagacgaacaagaggtgatctatgagcagtggaacattgaaaaacttccgtctgagctttcggagaaatacaatctgacagaagatgaaaaagaaaggattctcgcagtgtttgacaaggagattcaggatatttcagcccggcgcggatatcagtctcaggatgtcatttctttatcagataccacgccgaatcttgatgaattattaaaaaatttccaaagagaacatcaccacacagatgatgaagtccgctttatcgtcagcggacacggcatcttcgtcattcaaggcaaagacggcacatttttcgacgtccgtttaaatccgggagatttgatttcagttccggagaacatccgccactactttacgcttcaggaagaccgccgggtcgtcgcaatccgaattttcgtgacgactgagggctgggtgccgatttacgaaaatgaaagtgtgcaaaactgatagacgcccgaacctctcatgcccccgccggcatgagaggttttttattgtaatataaagtcagctgtggctgttttttaaatcttgaatatgccgcattctgtttatatcattacctgaatgggtattattctcgtattcatgctaaagattccaatatgaaatgaaaaaataagttatttagtaaaaaaatgtttacaaataaagtataatctgtaataatgctcaataacccaatcaaacttgtttcctattcttttagcggtgaggggtgaagtgaatgggcagttattctgaacaagaaaaattgcttgtatctattgataaaaaaagaaaaatgatgatagatgcggctaacagacaagggtttaccggatatgacacgatcaggcacagccaggaactggactgtctgatgaacgcgtatcagcagctggtaaaccgtgatcgcacacatcaccaaggaatacagggccttgtgaagaaaataggcttgttctcccgcggtgacgtcatgcctgcatatgaagcaaacaaatgattgatgataaaacagataacgaagactgaatgcgcttcctgatcaagcgccgcatccgaaagatgaccgcgtacagtcagcagatttttccgctggcacggctcacgaagcgcctcgtactatctgccggctatgatgccgttcctctggtatatcctcttacacatattcttctttaaataaaaaacaccccgatccagggtgtttttttcatcgtgaagcggcagggagggtaatggtgacctctgtccccttatcgacttcgctttgaatgtcaatcgaaccgccgtacatcagcatgattcgtttacatacgacaaggccgaggccggtgcctttttcctttgacgtgacaaacggaagaaaaatgtgttcaagcatatcttcagaaatgcccattccgttgtcggccaccttaatgactgctttatggtcgcgggcttctaaatagatggacagccggccgccttcctgcatggattccagtgcgttttttgcgacatttaaaatcacctgtttaatatggtctttcgtacagttgaccttgagcggccgattgacgagaatctccacattcacttccacattatacagattcccttcagaataaataatcggcataatctcatcaagaatatcctgcagcgagttcacttccaaccgttcagcagtcggttttccaagcactaaaaactcactgacaatctgattgatccgcttaatctcctgctcaataattgagaaatacagctgatcttcctccgatttgtattttttctgcaaaagctgaatgaagccgctgatccctgtaagcgggttgcggatttcatgggcggtgctggcggcaagcgttccgatcagctccaatttctgcgcttcattttgagcgcgctccagctgggtcttgcgcttaagcagataatattgaacgaggatgaacagaatattcagcagcacggcaatactggacatcggcagcagcacgcttttggtcagctcgttcagctcaaccggtttcggataaacattgatattccaattaatatcatccagatagccgctgaccggttgcaccccttctgattgatcagcccgtccgctggcaaatatcactttattctgattggttgccttgacataaacgtcagggctcagcatattgatcatatttctcaaataatcgacttggatggcggctactaaataatccgtgacttcccgttttgcgtctaacaccggcacgcagatcgtgaagatgcgctggcctgtaattctgctggagtagtcatttgtgataaccgtttttttcgtctttttcgccttcgtaaaatacggtctgtcggccaaattcacctttgatttcagatcagtcgtgcttgcgatgacatcacctttggaattcagcatatacagaccgctgaatctgggttcatcctcaaaagcctgatcgagaatatcaatgatcttttcttcattgacaggcttatcgacagcgatcgcaagtgttgtcatccgggcttttgtttcaccgattaaataattgagcttattgcggtgaaggttgagcatcatactggcttcctgtatgtgtttatcggctattttctgcttttctttttcataaatgaaaaagctgataataagtgccgggatgatcaccaatatgagataaagtttgatctttcccgggcacctttaaatgtattcactctgcatcgctccaacatcacacttgaatagaggtattatatcatttttatacttctttaataagaaaaaataaccaaaatgatagaaaaacaaattattttattaaggccagacaaaaagaagagaaattttggaaacatttttgttgacatttttcattttgtttattaatgtttctctgtaacggtttcttttgtaaaaggatgattgaatgtatgacggataaaacagaaaactcattgaaattatttattgtactgtcacgtgcgtaccgatctattaacgaccatatgaataaacatattcataagcacggtctgaacccgacggaatttgcggtgcttgagctgctgtaccacaaaggcaaccagccgcttcagcagatcggcgacaaaattttattagcgagcggaagtattacatacgttgttgacaaattagagaaaaaagaacttctcatcagaaaagcctcgccgactgacagaagagtgactttcgcacaaatttccgaaaagggaatccgtcttttggacgatattttccccgatcatgctgaagaaattaaagaaatgatcagtgtgctgagtgatgaagagatagaaatgtgtacggaaatgctgaaaagagtggggttaaacgctaaacattttcatcagaaataaaaaaggaagccgtttgaaaggcttccttttttatattactgattttggtcagtcgcggcgtttctaggctgtatcaatacctcgacgcgcctgtttttgctgcgcccttcagcggttttattcgacacggccggtttatactctccgaaacctttggcgctgaatacttttgcgtcaagtttcgggttttccgtgagaatagccatgaagttgacggcccgcatgacgcttaaatgccagttagattgatattgtgagtttttaatcggcacattgtccgtatgtccgctgatgataatgttcctcggcggattcagcacaaggagattcgagatttccttcgcaagcggaatatcttcctgacggatatccgcccgtccggaatcaaaaaagatactgtctttaatggtaattaagagtccttctttagtcagctttgtttccagctgagtttcaagctttttgttttttataaattgattgacttgcttttgcacgccttcaagttcttcgcggtcggctgcttctctttctttctttttctgttctttatctttttccttttccttgtctttttttaactgatcaatgccgtctttttcgttttcaggaggggtgacgcttgaatattcaagaacacccgtgcctccggtaaacacggcgttaaatgatttagacagcatttggaatttcgccgcatcgaccgagctcatggcgaacaatacaatgaacagagccaaaagaagggtgagcaaatccgcgtacgggatcagccaagactcatccacatgctcgtcatcatgcttcttcttcttttttctcgccattgtttgcctctccttcttgttcagcgacttttgcgcgttcattcgcaggaagatacatgagaagtttttgttcgatcactttcggggcctgtccttcaagcactgacagaacgccttcgatcatgatttcacgcagtttgacttcctgctttgatttgcgtttcagtttgttggcgaagggatgccaaagtacataccctgtgaaaatcccgagaagggtggcgacaaacgccgcactgatggcatgtccgagcgcctcggtattgttcatgttggaaagagcggcgataaggccgatgaccgcacccaaaacgccgagtgtcggcgcatatgtgccggcttgtgtaaagatggctgcgccggcctggtgtctgtcttccatcgcttcaacttcctcagtcataatatctctgataaattctgcgctttgtccgtcaaccgccatgctcaggccgtttttcaaaaatgcgtcatccacgtcttcaatgcttgcttctaatgcgagcagaccttcacgtctggcgatttgcgcccattgagagaacataggaattaattgcgcaattgtcagctgtttgttttctttaaacagcactttaaaaagggcaggcacttttttgatttcttttccggggaatgcgatgatcaccgcagaaatcgtaccgaacaaaataatcagaatagctgccgggttagcgagtgcgcttaagctgacccctttcagcaccatgcccacgcttaaagcaatcacggcgaggatgataccgataatcgatgttttatccatagttttcaccaaatcctttatactagctttctatggttaatatcggtggcagtgcatggaactttagggtgattgagaaattgttcccgaattcttcacagtttctcccttccggcatggagaaataacaaaaaagcggctccccgcgaggagggaaccgcttttttgttattgtgcccggactttgatgccgtcctcttccattacgacatggaaggctttgatttcgttgtcatccaatagaagatctgtcatttcgtcctcgatcaattcttggatggttcttctgagcgggcgtgctccgaaagcggggtggtagccgatttcagcgattttttctttcgcatcatcggtgacgctcaggctgatgccgcgctcttttaatgtgtcttcaagctctgtgagaagcaggctgacgattttcacgagatgttctttttttagggattggaattcaataatgctgtcaaaccggtttaaaaactccggtttgaagaacgcgctcagtgaatcaatcagcgtttgttcttccatgacgctctcttcagattggaatccgactttcacctgtttttcgccggttccagcgttgctagtcataatcaaaacggtatctttgaagctgaccgttctgccctggctgtctgtcagacggccgtcctccataatctgcagaaacatatgctggacatcagggtgggctttttcaatctcatcgagcagcacgatgctgtacggattgcggcgcactttttccgttaattgaccggcttcatcgtgtccgacatatcccggcggtgaaccgataatttttgatacggcgtgtttttccatgtattcactcatatcgagacggataatggaatcttttgtaccgaacagttcatctgcgagtgtctttgataactcagtttttccgactccggtcggtccgacaaagaggaaggagccgacaggtctgtttttggattttaagccggcgcggcttcgtctgaccgctttcgccacttttttcacggctttttcctgaccgatgacacgctgatgaagatgctcttcaagttccttcattttgacttgttcatcagcctggagttttccgaccggaatgcctgttttctgttcaatgatggcttgaatatgctccgcaccgatttcaggtgaagaggccggtgtttcatgcgccagctgcttttccaaagccgcttcttcatcacgcagtttcgcggcaagctcataattttcttcatgaagcgcttttgttttctccgcgtcaattgctttgagtctctcagccgcatcttcttcatttacggtatcaagctccaggttcgccttagagccggcttcatctaataagtcgatcgctttatccggcaggtggcggtcctgaatgtaacgggatgaaagcgtaacacaggcgtttattgcttcattgctgaatgtgacgccgtggtatttctcgtatttatctttaatgccttccagaatgctgatggcttgttctattgtaggctcgtgaaccatgacaggctggaagcgtctttcaagcgccgcatctttttcaatctggcggtactctttcagcgttgtcgccccgatgacctgcagctcgcctctggcaagcgccggtttcaggatgttcccggcatccattgatccctcggcagagccggcgcctacgagaaggtgaatctcatcaatgaacaagatgacgtttttccgttcttttaattcgttcattaattgtttcattctttcttcaaactggcctctgatccctgtattggcgacgagagaagcgacgtcaagcaggtaaagctctttgtttttcaatttgttcggcacatcgccctcagcgattttaagcgcgaggccttctgcaatagccgttttaccgacgcccggctcaccgatcagcaccggattgtttttattccggcggttcaaaatttcaattacgcgcgccacttcattatcgcggccgatcacagggtcaatcagacctgcttttgcgccgtttgtgacgttttgagcgagctcgtcgagcaggcctttttcagggccggactgctgtttattttgattgggagcgaaaccttgctcaaacgggaatccgaatgattgcggccccatgctcatagacggttttcgggttaattctgtataacatgtttcacataaaacgaattgtttttgaatggaattgacttgcatgttcaggcgaatcgtcgcctcgtttttctgacaatgttgacaacgcatttgccaaaacctcctcgaaaaatgtttgatcatctttgaccaaatggattagaaaataaggccgaaactttgaccttctttgattattagtatactctgaccttctttgactttcaagtattttgtttcaaaccccgaaaaataaatgtttacagcatgataagtgatattcgtgaggtttgattatttttgaccaatatagtcggaaaggaaatggaatgatttgacctttcttgatgaagagtatacgccggccctttttttctttcaatatttttgcttagaggagagagctgaatctgttttttccggggaaggacgatttgttcgtcttttcgggagacttgtctcataagcatatataaaggcctggacaaatctgcgtttagccggagggtgaaatgggacaaacaaaaggttctgcaagtcagcttgcatttgtatacgtaggcacggttgtaggagccggttttgccacgggacgggaaatcgttgagttttttctgaagttcggctggatcggtctgttcggtatcgtggtaagcggtctgatgtttacatatttaggcgccaaaatcatgatcatttccaaacggattcatgcagcatcttatcaggaattgaacacatatttattcggccagtccatcggccgcgccgtgaacatgtttatgatgtttatattgctgggagtgacctctgtcatgctgtccggagctggagcgctgtttcatgaacagcttggatggcccgcacaagcggggatccttctgacgatcgtactgagctttgccgtcatgacaagcggtgttaaaggtgtggtcggcgtcaatatattggttgtgccgcttttaatttctttctcttttatcgtgacagctgattcatttgtatttacaagcacgagaaacgcggacgaatgggtatggcctgataagtggaactggcttttgtccgccgtctcttacggcgcgttaaatttatcgctcgcccaagccgtccttgtgccgcttgcgaacgaaatgtcttcagagaaggtgatcagaaggggagcttatttaggtggcgttctgttgacactggtgcttgccgcgagcttcttatcattatcggtgctgccggatgtgctggagtttgacattccgatggctcaagtcgtctattcgtattcgcgttcgcttcatatcatttatttgtttattattttcggggaagtgtttacgtcggttatcggcaatttatacggattggaaaaacaattaaacagttttcttcatataaaaagtacatatatttacggcggcattttggcgtttgctttcattatcagccaaatcggttacgggcagctgatttccaccgtttatccggtgtttgggtatgtgagtctcgctttcatcggcgcattgatttgcaaaaaaatcccgaaagaaaaataaggatataaggaaaatgtctgtattttttgggaattccccttcttttttactgccatttctgtataatgaattgggaaatgatggggaggagtaagagatgaaggatcgacgtgtattattgggatttatttttatttgtatcggcattgcgttttttttacagaaggcgggagttatacatatatccgcaggttcggcgtggccgtttcttttcattataatgtccgcagggtttcacgccggatttatttttgcgaaaaaaacgcctgaacaggcgggactgctcgttcccggcggtatgtttcttgtgctgggctgcctgttttgttttgagaccgcaacgggatggacgtattcaggcgtgacgtggcctgtttatatatgggcgcctgctctcggtctgtttgagctgtggtatttcggcgggagaaagatcggcgtattgattcctgctttcatcctgacagccgcgggagcactatgctttgccggaatgctgatgacggggctgtggccgcttttgatcatcgcagccgggcttttgtttcacgccgctgcctttatgcagccgaaaaaaagatcgggccttcttattccgggcggcattttgcttgtgacgggcggcttgttatggtttgaaacgctgacggattggacatacgcaaatgtgacatcgcctgtctacctctttgccgttgcgttcggcctgtttgaagcctggctgttcggcagaaggcaaagagggcttttgactgctgcggcggttctgtgcgccgcgggcattttcggcatattcaccaatgcaaatgaagtcatcagcgaacgcggctggcccgttctcattcttttgctgggcgccgcttttcacattccgattttcggcccgaaacctgtcaaaaacgcggggcttctcgtaccgggcggcatcttattgattacggggttcttgtttgtctttgaaacggcaaccaattggtcttactccgatgtgacatggcctgtttacctgttggcaacggcattcggtttatttgagctgtggctgttcggcgggaaacagaaggcgctgctcatcccggttgcggtgctgaccttgacagcactttgctttatgatgacgtatcagccgatcattccggtttctgttttctggcctgctctatttgttctgatcgggattgcgctgatggtatttccggggaagaaacgcggggcttaaacccgcttttgcagcctgacacaggtttcaggctgtttttttattgtcacgggaaacaatattatggtatgatagcaaaagtgaaaaaagaagaaaatccgtattgatgcgggagaggttctagctacaccctctataaaaaactaaggacgagctgtatccttggatacggtttttttatgttttttagggcgccttctccgaaaaaggcgctttttttatggaatgatagataagggagagaaagacatgaaaaaagaaaaagcagttgtggtgttcagcggaggccaagacagcacgacttgtttattatgggctttgcaaaactttgaagaagtggaaactgttacattccattataatcagcgtcaccaagaagaaatcgatgtggcaaaatcgattgccgaaaagctcggtgtcaaaaaccacttgcttgatatgtctcttttaaatcagcttgcgccgaatgcgctgacaagagatgatatcgaaattgaagcgaaggacggggaattgccgacaacctttgtgccgggacgcaaccttgtatttttatcctttgcatcgattcttgcatatcaaatcggtgcgcgccacattattaccggtgtttgcgagactgatttcagcggctacccggactgccgtgacgagtttgtcaaatcctgcaatgtcaccgtcaacttggcgatggaaaagccgttcgtcattcatacgccgcttatgtggctgaacaaagcagaaacgtggaaacttgcggatgagctcggcgcgcttgattttgtaaagaataacacactgacttgctataacggcatcattgcggacggatgcggcgaatgcccggcatgcctgctccgcaataaaggatatgatgaatatatgaaaatgaaaggagagcggaactaattgctttctcaaatttacccgcaggttcagcatccttattcgtttgagttgaataaggacatgcacatttcagccgcgcactttattccccgcgaaagcgccggagcgtgcagcagagtccacgggcacacgtatacagtaaatattacagttgcgggggatgaactggacgattcaggctttctcgtgaatttcagcgtgctgaagaaattggtgcacggcgcttatgaccatacattgctgaatgaccatgaggaattttctgaagatgacagatattcactgccgacgaccgaggtcgtggccaaaacgatttatgataaggtgcagtcctacctcgaaacactggagaatcagccggtctgcgtgcaggtttttgtcagggaaaccccgacaagctattgcgtataccgcccgaaaaaaggtgataggaatggctaaaggaattccggtattagaaattttcggaccgacgatacaaggggagggcatggttatcggccagaaaaccatgttcgtccgcacggcgggctgcgactactcctgcagctggtgcgactccgcttttacatgggacggctcagccaaaaaagatatccgctggatgacagcggaagacatttaccgcgagctgagagaaatcggcggagacgccttttctcatgtcaccatctcaggaggaaacccggcgctgttaaagcagcttgacgcgctgattctgctgctgaaagagcacggggtgcgcgccgctttagaaacgcagggaacggtctatcaggattggttcacaatgattaacgacctgacgatttcaccgaagccgccaagttcggggatgacaaccgattttgcaaagctcgatcacattgtgtcttcgcttgatgcggcagaaaggcttaacgcggtcagcttaaaggtcgtcatttttaatgatgaagatctccaattcgcgaaaaccgtgcacaagcgatatccgaatattccgttttatcttcaggtcggaaacgataacgtccatacgacggacgaccgggcattgatcgcacatctgctcggaaaatacgaaacactcgttgataaggtttctgccgattcggatctgaatctcgtcagagtcctgcctcagctgcatacattgctttggggcaataaacggggagtttaatagaaagggagatttatatgacaagaaaagaatcagaattagaaggagttacgctcctgggtaatcaagggacaaactatttatttgaatatgcgccggaggttttggaatcatttccgaataaacacgtgaaccgtgattatttcgttaaattcaactgcccggaatttacgtcgctttgcccgaaaacgggacagccggattttgcaaccatctacatcagctatattccggacgaaaaaatggtggaaagcaaatcgctgaagctgtatcttttcagcttccgcaaccacggagatttccacgaggactgcatgaacatcatcatgaatgatttgatcgaattaatggacccccgctacattgaagtatggggcaaattcacgccaagaggcggaatctccattgacccgtatacaaactacggcagaccgggaacaaaatatgaaaaaatggccgaacatcggatgatgaatcatgatatgtatccggagacgattgacaaccgttaatttcagacggagtacggactcggaatataacctaaatacccccggttgcggtccgaagtgtgaaacggagtgaggtcacggtaaaacccgaacatttagcgtcagttttagacggaaatgtgagcgagtcacagcgaagtgtgacccgactgtgacccgaagaagccatagtgtgaccacgatccctgtctttctaggcggggatttttcaatacgttctatttattcagcgtcctcaatttcgaatagctcatcgacttctacgtcgagcgctttcgcaatcgaaaaaacgtgccagtcttagtggcgactattcttatcgaagcgcgatatcgaaccttgtggcacaccagatgcttccgaaagtcttacctgcgtccaccctttcgccttcataacggcgtttaggcgcggcgctgcatttagtttcattttgaccacctctgcgaccattataagtctttttaaaagagcaagtatagtctattcagtttatttctaaggttgcttacgctcaggtataaaaatatataaaatgctccacctaaatgttgaaaacgaaagcaattgcaataagagcagttgctttttttagccgggcagcattcctgtaataaataaaaatttaattttggaagaaacatggcagttagcacaacagaaaattataaaaaagatataatagttctaaataacattaacttggagggaaaaaatgaatttagaaatacgattagcaagtgcagaagaatatcagattgtgcataaaattatgttagaggcatttgaagaatatagatttcttgaagttccctctagtgcattaaatgaaccgttagatcatctattaaatgcaatgaaacaaggattagaaaaagcattgttgtgctttgtagatggggaaccagttgcttcttctagaatcacattaaaagatacctcgatatatttttcaagattatccgttacatcacacgcaagaggaaaagggatagcgaaagcaatattattatggattgagaattatgctattgaaaataaaaaaaagaaaatagaatgccgtgttcgtgcatcattaccaaaaaatataagcttgtacgaaagaatgggttacatagtttataaagaagaaacggttaccaaccctaatggttatgaagttaaaacagtagtaatggaaaaacctatactttagaaactaggtgaacttcttgtaacaaatgaactgcaaattggataatttgtgaagtaatacacttaacaatcgggtgcatttgcatattatatatgtctaatatgtatgaccccttattttaaatgtagtcttgattacagcaggacgatgtgataactgcgactatatgctattcaaaagttcggtgaagaatgggaagtttcctcgggagtgccggcggtctcggaatataacctaaatacccccggcttttaagcgggggtatttttcgtctctgccacgcagccaaaaaggtgcatgatattcgcacagaacttctataagggaaagagagatcatttggagaaaagaaaaagacgagtaaacccggggggagtgtactcgccgcttcaatacgtgacgggtgctggatggcagctcgtctgtttcattataaaatagggaacgtatgtttgtaaagacctgcgctgttttttcttattcggagcggatcaattgtaaaggaatggccagcatggtagcatgtcctgtaaaaagaaggagtgttcgttatggagccgttagagttaaacggtgtaaggctgaaaatgtatgattgtaaagaaagtgcgggtaaagacggccgtatgatttcattcgtattgaaggtgacctctgaaacgtatcatgatattgccgtccttttgtacgaaaaaacatttgacatcaaggcgcccgagcgtgggcttgaattccgcggtaaaataaccaactactatacatccgtcacaaatctttacaataaagatgagaccggtgatttttttgtggaaatgaccgagatctgaattcatttgaaaaagctgccgggcggcagcttttgtgcgggatatgtaaatggttcggattgttcggggggtttaataggagtctctgatgattttataattcttatggttgacgacagtgagggaatctaattcaaggtcacgataattatccatgatggttacatcaacgatgacggagttttcatttactttttcaacaataccggttaatccgtttttaaattcaatgacgtttccaaccttagcaattttcacgagcttcctctcctttatcataaatcctgtttgaaaatattttgcagtattttctttaagaagtaaagcgatatgggtatcagcccgctcaatcattgtcccggcgggggaaagatggtatattgtttttcgggaaaaagccgagaaaaggaggctgtattcgttgctgcctgaggaaatttcagaacgtatcaaccaaatgcgcaccggtgaaatcaaagaattcagggtgcagaaagaacattttcttgcatttcgagcagttttatcgaagcaggaagattttaagcatttccgcggtattgcccagcagggcggagatgttatcttccagtatttagaacatccaagaagctgacggctcctcgcccttgaggagtctttttttggtttcagtttctcatttcatctggctgtaacagatgtaaacaaaatgtaaaatccctccgatggatacttttactgctatttggttaatgttgtgaaaatgacggctgttttcctgccaataacaaggctgttaacaaacttcttccattataaaagctgattgggagcactggaaaatctttaaacgtgaatttgcgcacagctcttgttaaggtagtgaagtatttaaggaggaaatcgtatgacgacaaaatttgctgccttggctgtcttttttctatgttttatgcctgcatcaaaaattgaacatacagaagctctgtttacttttgcgaagaagccaaagcaagaacccagcaccctggttgctgatttaaataaaaaaagcccggttccgaagctttcaaaaacggatcataagcattctatccaaccgataaagctttcatctcaccaagagaagaaagcaaaaccggaagagacggcttatcagccgccgaaaaaaacgtattcccgcgctgacagacaactcctgtcacgtctcgttcacgcagaagcgaaaggtgaatcttataaagggaaggttgcggtagccagcgtagtgctgaaccgcactgaaaaaaacggtttcccggataccattcggggcgtgatctatcaaaggaatgcatttgaaccggtagcaaacggaagcattaatcaaaagccggataaggattccatcgccgccgcaaatgaggcgcttgaccatccgggcagagaaacgaacgcgttgtttttctacaatccgaaaacggcatctgaccactggatccgttcccgaaaaattatcgaacggatcggcagacacgtatttgcgatgtaagcatagcgggatcaaaaatatccccgctatgcttttttcaattttgagaaatcgaaaatattttcagaacttgtctcatatgatgatggaagaacgtgagacaaggagagacaccatgaatcgatttgtgaaagggatcattcttttatccatcgccgcctttttcgcggaatgtctggaatttgtcgtgaatatgatactggcgcgggagcttggcgagcatgggatggggctttacatgagcattctgcccaccatctttttaattatcgtaatcgccagtctggagcttccgatctctatttcaaaattcatcgcggaatccaatcagaagctgcatgaaagcatgctccggcatgccttcagaatgaccgccgtttttaccgcgttttcaaccgcggccgcaagcatcgcgctgccgttcattcctgtattcgatacgtatcacccctttattaaagggattgtcatcgggctgattccagttgtcgcttttacatccatcgccagaggttattttatgggtgtgcagcaaatgggaaaaatcgcggttgcgaatgtcttgaaaaaaatcattcaagtgctttgtctgtttatcttttttcaatggtactcttttgaaattgatatggccgtgcttatttcgttatttgtgctggtcgcaagcgatgttgtggtgttcgtttatttgtatacgcagtttattttggcgcggagggcgctttccggccatcagcacattcatcttcgcgggaaagacgtgcggaaacgcctcctggccgtatccatcccgacaacgggacttcgtatatttcatgcggtgacaaacgcagttgaacccttcttggttaaaggagcgctgctggcgtccggggttgccgggacagctgcgattgatcaatacggcatgcttgccggtgtagcgatgacaatcggttcgtttcccgcatttatcgcccattcgctgatggtcgtcatgattcccagcatttcagaagcatatgcgctgtcccaatatgatattgtgctgaaacggctgagacaagcgatttttattacattcggctacggcattccggcagtctgggtcatgtttcagttcgcaggcccgctgacccatttgttttttcagtctccggaagcgcagtattatttgcagcttttgtggccgttttttctttttcatctgtttgtgatgccgcttcaagcctgtctgatcggcatcggccacgtgaaaacggcgttttatcataacgtatggagcagcattgtagggctttcgatgatgtatgtgctcggttctatgccggaattgcaaatgctcggcattatactcggtatgaataccggcatgatccttctgacaagtttacattacgcgacgatctgcaaagacctcggtgtctccgtgtttttgacgggcggcggaagaacagcgccccggatcgaaagctgaaaaggctgatacatttcaataaggaagggcaagctatccgaaacgcgtgaaaggaagatcatatgcataaaacccgcctaattgtatgtgcagtccttttgatagctgccgccgtctggatgcctgaagcaaaagcctcatcagaaaaacaggcagttcccgccgtgtttctgatgaagacgattgaaggagacgaaatatcgattccgaataaagggcagaaaacgattttacatttttggacatcgtggtgtccgccgtgcaaaaaagaacttccgcaattccaaacgtattttgaacagcatcagtccgatgatgtaagccttgtaacggtaaatttgatgaatgccgagcgaaataaaaataccgttcaaaactttgtcactcagcaccatctcacattcccgattgttcttgacacgaaaggcgagcttatgaaggaatacgatgtcatgacgattcccacgtcatttctgctgaatgaaaaaggagaaatcgaaaaaaagatcgtcggtccgatgaccgcctcacaattaaaagaatggtcagagaattaaaaaggtgcgggaggaattcctcccgcacctttttttgcatataatgaacagctgaagaaacgctaatgataattattatcaaaaagaaattaaaacaattataattgaaatcttccgccggcatgctataataaagaaaacactgcgataacactgtgaaaatgctgcctgtcaggcggctgttttacttttatcggggaattgaagatgatttgcgttctcaattagagaggagaattcataatgaatgaacaagtgatgacacaaacccattcacaacagcagatacaagaagagcgggccggaaaaaaatggctccagcatgcagaactcattgcggcgctcgtatccggcgtccttattcttgcggcctggttttttagcgaaacaaaaggcctgtccgtcactttgtatatccttgccttcctgatcgggggatttgcaaaagcgaaagagggaattgaggataccattgagacgaaggcgttaaatgtagaactgctgatgatttttgcggctgtcggctccgccctgatcggttattgggcggaaggcgctgttcttatctttattttttcgttaagcggcgcgctcgaaacatatacgatgaataaaagcagccgtgatttaacatctttgatgaaactggaaccggaggaagcgaccctgcttgcggacggacgggaaaagcgggtgccggctgctgaacttaagatcggtgacatgatcgtcattaagccgggcgaacgcgtagcggcagacgggattattgagtctggcgtgacgagcctcgatgaatcggcgctgacgggtgaggcgatgccggcggaaaaaacagcaggagattctgtgtttacaggaacggtaaacggaaacggctccttaacggtccgtgtgacgaaaacaaatgaacagtctttattcagaaaaatcatccggctggtggaatcagcccaaaacagcgtgtcaccggctcaggcatttattgagcgattcgaaagtgtctatgtcaaaggcgtgctgttagccgtggctgtgcttttattcgttcctcatttcgctttaggctggagctggagtgaaaccttttaccgggcgatggtgtttatggtggtcgcctccccgtgcgcgcttgtcgcttctattatgcccgctgcgctttcccttatctcaaatggggcccgcaacggattattggttaaaggaagtgtgtttttagagcagctgggaagcgtacggatgatcgcatttgacaaaaccggcacggtcacaaagggacagccggcagtcgcggcatttcaagcagcggaacatgtgagtgaagatgagatcatgcaggcggtgtatgcgatagaaaagcaatcaagccacccgcttgcaaaagcgatagctgaatttgccgaaagccggggcgccgcgcccgcaggccatctatcgattgacgagacgtcgggattcggcgttcaggctgaaatagaaggcgtcaaatggatggtcggaaaagcgggatttgcaggtgaacatgcggcagatgcttttttgcagacatcgggaaaagaattaaaggataaaggctttacactggtctttgttaaaaaagatgaccggattgcaggctgcttcgccttaaaggatcaaatccgccctgaagccaaagccgtgatggctgagcttgaatcactgggcattcaaacagccatgctcactggcgatcagtctgaaactgcggctgccatcgcgaaagaggcgggcatgacgacggttgttgccgattgtctgccggaccaaaaggcaaaagaagtgaagaagctgaaagaaacgtacggcacaatcgccatggtcggagacggcattaatgacgcgcccgctctgaaaaccgctgacgtcggtattgcgatgggcgggggaacggacgtggctctagaaacggctgacttagtccttatgaaaaatgatcttcacaagcttgtgaaaatgtgcagactctcaaggaaaatgaaccggattattaagcagaatattgttttctcgctctcggtcatctgccttttgatctgcgccaactttctgcaggtgatggaactgccgtttggcgtaatcgggcatgaggggagcacgattctggtcatactgaacggactgagattattaaaataaacatgacagccgcacacgggcggctgtttttttaatgttcgttcacagcataaacgccggaaaactgatagaatgaataaagagtcactttggtaaggaggaaaagcaaaaaatgaacagattagaacgtgtttcatcttggctgaaaaaagaaggacatgatgcggcgtttatacatacaaaggaaaacgtattttatttaactgatttttacacagatccgcatgagcggttaatgggattgttcctgtttcaggaacaggagccgtttttcgtttgtccgggaatggaagccggacaagcccgaagcgccggatgggagcatggtattatcggctacggcgatcacgaagatccgtgggagctgatcaaagccgagctcacaaaacgaaatgtgccgcttgattccatcgcggttgaaaaggattcgatctctctttcccgctcagaacagctcaaacaagcttcagggggcgcagcatttgtttcggcagaagaaacgctcaaccaattccgcctcgtaaaagatgagaaggaaatcagcattctcagggaagcggcaaaactcgcggattacggagttgaagtcggtgtcgcggcgcttaaagagggtgtgagtgaaaccgaagtactcgcacagattgagtttgagctgaagaaaaaaggtgtgcagggcatgtcattttcaacgatggtgctgttcggggaaaaatcaggccagccccatgggaatccgggtgcagacaggttgaaaaaaggcgattttgtcctgtttgatctgggcgttattcttgacggctactgttcagacattacgagaacattcgcataccaatcaatcagcccgaaacaggaagagatttacgaaacggtgcttaaagctgaacaggcggcgcttcaattaagcaaacccggcgtcagaatcggcgatcttgatttaaaagcccgcggcattattgaaaaagccggatacggagactatttcccgcaccgcctcggccacggactcgggatttcggttcacgaatatccatcaatgagcagcgcgaacgacacactcctcaaagaaggcatggtgtacacgatagaaccggggatttacgtgccggatgtcggcggcgtgcgcatagaagacgatgtgtttgtcacaaaagacggcgccgaagcattaacgcagtatccgaaagaattaacgattctgaaatagaaagctttgtgataaaaaaggacggttctggaacgcagcgtccttttttatcaccttttaaatgaaaaaatcatcaaaatgctgaaatggtttgatatcatgcttttcattcaggggccgcagggcaaggtaactgccgccgagtatggccagacacaaaccgattaagcaaagaatccccatcgctgttcttctcctttcaaacgaataggatgtatctgtttctagcttactgtatgaaacgcattccagatcaagggaaaaaaagaaaggggggacgccatggctacgatcagagacattgccggcgctgccggggtttccgttacaacggtatcaagagttttaaacgatcatccttatgtaagtaaggacaaaagagaaagagtgaaaaaagcgatgcaatcgctcggatacacgcgcaacattcatgctgtgcatttatccaaaggtttttccgatatgatcggcgttgtgcttccgtcggtgaatcttccgtattttgcagaccttgttgcaggtattgccgaggctgccgaagcgtcaggcgtgcatctttctttataccagacagattatcagcagaaaaaagaacgttttgccttatcgcaattacaggagcgccaagtggacggcctgattatctgctccaaagcaattcctgatgggcatctgcttaccgtgaaagaaccgctcatcctctgccagtacactgatgcggcagggctttcctccatcagtaatccgcatcgggaagcatttcggcacggtctggattatctgatagaaaagggacaccggaaaatagcgatcagcctggccagaaaaaagggaaaaaacagtcaagtccgcatcgccgcatataaagaggcactgaagaagatcgggcagccttacagggaagagctggttgtggaaaaggtgctgacgctgcttgacgggaaagccctttttcatagatggaagagctgggatgacaaaccgactgcgctgtttgcggcgaatgatcaagtatccgcaggtctttaccttgaagccaaggcaaacgggacgcgcatcccggaagagcttgcgattttgagcatcgacaatcatgatatcagcaagatgttaggtatttccacaatagatatacaaacgaaagaaatgggaaagcaggcttttcacatgcttgagaaccggatcagcggcgggcctccgggaaggaaagttcttgattaccgccttattgaacgatcaaccgtctaaaaaaagaattgacgcgctttccgttcgttttgtacgatatgaggtattgaatgacaaaggagctgaggatcatgaaggggtcctttacagttgaaaaggtattaaataacaatgtgctcatcgcaacacatgatagatacagtgaggtcgtcttaatcggaaaagggatcggctttggaaaaaaacaagcggatgtcattgaagataaagggtatgacaagatgttcatcttaaaggatgaaaaagaacaaaaacaatttaaaaagctcctcggttatgtggacgagacacttgtcgacatctccaatgacgtcatttatcatatcaagaagcggacaagccaaccgttaaatgagcatatccatattgcgctgactgaccatatcgcctttgcggtaaagcggctgcagcaggggtttgacattaaaaacccgtttctcatggaaaccgaaacgctttatccggaagaattccaaattgcccgtgaagtcgtcggcatgattaatgaaaagacgggaatctgccttcctgaaggagagatcggctttatcgctctgcatatccattccgccctgacgaatcggcccctttcagaggtcaatcagcattcacagctgatgtcccgcctcgttcaggtgattgaggaatctttccagatgaaagtgaataaagaaagcgtccactatttgcggctgatccggcatatcagatttaccatagacaggattaatcgggaagagcagacaaaagaaccagaaaagttaatgttattattgaaaaatgaatacccgctatgctacaatactgcttggaaactgataaaaatcttgcagcaaatactgaaaaaaccagttcatgaggcggaagcggtttatctcacgcttcatttgtaccgattaaccaataaaatttcataatttcagttgaaaccttaaaaacgtgtcactgattcgatcaggcatgagtgattgagggtaaaaaacgggaagaacgatcccgttattttgcacaccctttttactcatgccttttttgttgtgtaaaagggcaaatgtaaacggttaaactgaagacttgcgccagtgaattcgttgtcatgaattttcgctgtaaggtcacactagctaacagaggaggtacatcttttatgtttaaagcattattcggcgttctccagaaaatcggccgtgctcttatgcttccggttgcgattttaccggctgcggggatcttgcttgcgttagggaatgccatgcagaacaaagatatgattcaagtcatgcatttcttaagcaatgataacgttcagcttgtggcgaacgtcatggaaagcgccggccaaatcgtatttgacaacctgccgcttctttttgcagtaggggttgcgatcggtcttgccaacggagacggtgttgccggaatcgcggccattatcggatacctggtcatgaacgtatccatgagcgccgtgcttatggcgaacggcagtattccgtctgacaaaattgaacgggcaaagttttttgcggaaaaccatccggcctatattaacatgctggggatacccactttggcgacgggcgtgttcggcggtattatcgtcggggttctggccgcgttattgttcaacaagttttataaaattgaacttccgcagtacctcggattctttgcgggtaagcggttcgtcccgattatcacatcaatttccgcattaattctcggacttattatgttagtgatctggcctccgatccagcacggtctgaattccttctccacgggtcttgtggaagcgaatccaaccttggcggcctttattttcgggatgattgagcggtcgttgattccgttcggtcttcatcacattttctactcgccgttctggtatgaatttttcagctataaagatgcggccggagacatcatccgcggagatcagcggattttcatggctcagatcaaagacggcgtacagctgacggcgggaacatttatgacggggaaatatccgtttatgatgttcggtcttccggcggcagcgcttgcaatctatcatgaagcgaagcctgaaaagaaaaaacttgtagccggaatcatgggttctgccgctctgacaagttgcttaacgggaattaccgagccgcttgaattctcattcttatttgtggctcctatcctgtttgcgattcattgcgtattcgcgggactttcctttatggttatgcagctgctgcatgtaaaaatcggtatgacgttctcaggcggtctgattgactacttcctgttcggaattctgcctaaccggacggcttggtggcttgtcattccggtcggcttaggactagcactcatttactacttcggtttccggtttgcgatcagaaagttcaatctgaaaacgccgggccgtgaagaagaggctgcggatgaaggtgcgggcgcctcaggcgaagccggcgaccttccttatgaaatcctgcaggcaatgggtgaccaggaaaacattaagcaccttgacgcttgtatcacgagactccgcgttacggtcaacgaccagaagaaagtggataagactcgtttgaaacagcttggcgcctcaggcgttcttgaagtcggaaacaacattcaggccattttcggcccgcgttctgacggtttaaaaacacagatgcaggatattatcgccggacgcacgccgcgacctgaaccgaaagtatccgcgcaagaagaagtcagccagcaggttgaagaggttatcgcagatccgctccgaaacgagcagggtgaagaagtgttcgcttctccgatcaccggcgaaatccatccgattaccgatgtgcctgaccaggtgttctcaggaaaaatgatgggtgacggttttgcgattcttcctgaagaaggaatcgtcgtatcgcctgtccgcggaaaagtgctgaatgttttcccgacaaaacatgcgatcggtcttcagtctgacggcggaagagagatcctgattcatttcggaatcgacacagtcagtctgaaaggcgaaggattcacttcttttgtttctgagggtgaccgggttgaaccggggcaaaagctgcttgaagttgatcttgaagcggttaaacctcatgttccttcattaatgacaccgattgtctttacaaatcttgccgagggtgaagcgatttccctttcggccgaaggtaccgtaaaacgggaacaaaaagatattgtgaaaatcggaaaataagcatataaatacgccgtgcttgtcagatgacaagtacggctgtatgatataatattgtgtagtaaaatagctttaatttaaaggagaatgataatcatggcacaaaaaacatttaaagtaacagcagattccggaatccacgctcgtcctgcgacagttcttgtacagactgcaagcaaatacgatgctgacgtaaacttagaatataacggcaaaacagtaaaccttaagtcaatcatgggcgttatgtctctaggtatcgctaaaggcgctgaaatcacaatttccgcttcaggcgctgacgaaaacgatgctcttaacgctttagaagaaacaatgaaaagcgaaggactcggcgagtaatgcaagaattaaaaggaataggcgcttcagccggaattgcgattgcgaaagcataccggcttgaagagccggacttaacggttgaaaagaaaaacattgctgatgctgcggctgaagtaagccgttttgatgaagcgattgtacgttctaaagaagagcttgaaaaaattaaagagcatgctttaaaagaactgggacaagacaaagctgacattttctccgcgcaccttttagttctgagtgatcctgagctgttgaacccggtaaaggagaaaatcagcacagattcagtcaatgctgaattcgctttgaaagaaacagcttccatgttcgttactatgtttgaatcaatggataacgaatacatgaaagagcgtgcggcggatatccgtgacgtaacaaaacgtgtgacggggcacctgctgggcgtggaaattccgaacccgagcatgatctcagaagaggttgttatcgtggctgaagatttgacaccgtctgatacggcgcaattaaaccgccagtttgtaaaaggttttacaactgatatcggcggacgcacttcacactccgcgatcatggcccgttcgcttgaaattccggctgttgtcggcacaaaagcggctacagggacaattgaaaacggtgttacggtgatcgtagacggcatcgatggtgatgtgatcatcgatccttccagtgaaacgttaaagaaatatgaagaaaagcacagtgcttacctggcgcaaaaagctgagtgggcgaagctcgtcaatgaaccgactgtttcaaaagacggccatcatgtagagcttgccgcaaacatcggcacacctgacgatgtaaaaggcgttcttgaaaacggaggagaagctgtagggctttaccgtacggaattcctttacatgggacgcgaccagcttccgacagaagacgagcagtttgacgcttataaaacggttcttgagcgtatggaaggaaaatcagttgtcgtgcggacattggatatcggcggcgacaaagagcttccttacctgcagctccctaaagaaatgaacccgttcttaggctacagagccatccgcctttgccttgaagagcaagaaatcttcagaactcagcttcgtgcgctgcttcgtgcaagtacatacggaaacttaaaaatcatgttcccgatgattgcgacagtaaacgagtttaaacaggcgaaagcgattcttctcgaagaaaaagaaaaactcgtcgaagccggcgtagcggtttctgacgatattgaagtcggtatgatggtagagattccgtctacagccgttatcgcagatcagtttgctacagaagttgacttcttcagtatcggaacaaatgacttgatccaatacacgatggctgctgaccgcatgaacgagcgcgtagcttatctgtatcagccatacaatccggcgattctccgtctgatcacccttgttattgaagccgctcacaaagagggcaaatgggtcggcatgtgcggagaaatggcgggagacgaaattgcgattccgattcttctcggtttaggcttagatgagttctcaatgagcgctacatccatccttccggcaagaacgcagatcagcaagctttctaaaaaagaagctgaatcattcaaagaaacaatcttgtctatgagcacgacagaagaggttgtcgcattcgttaaagaaacattcaataagtaatacaacagccagacggtataagccgtctggtttttttcatattcggaaaaaaggggggaacaataacgttcaacaggagggattatcatgacaaaatcatttgcagcgggggatacggtctatgtgatttaccgcaatccgcatgccgccaatgttgcccatattaaagaggcggagatcgtccatcacccgtaccatgagggagaactgtctctgtttttatacgaaacctatcatccgctggccgaagatgacgcggtcttttcgacatatgaggaagcggaagcgctttacagcgagctttttgaagaagaccggtaccattgatcaaaggaaatgtttacaacgcatattcactctcttttaaacggaaagtaacaacatgagaaaatgtaaaaagggagtgtcagttcatgctgaagccgtttgtgccccagcttgtttatatagaaccgagagcgctcgaatacccgttaggacaagagctgaagaataagtttgaaaacatggggcttgagatcagagaaacaacatcgcataatcaagtccggaatattccggggaaaaatcacttgcagcaataccggaacgcgaaatcaacattggtaatcggcgtccggaaaacactgaaattcgattcttcaaagccgtccgccgaatatgccattccatttgcgacgggctgtatggggcattgccactattgctacctgcagacgacgatgggatcaaagccttacatccggacatatgtcaatgtggaagagattctggatcaggctgatgagtatatgaaagaacgggcgccggaatttacaagatttgaagcctcttgtacgtctgatatcgtaggaatcgatcatctgacacatacattaaaaagagccattgaacatttcggacaaagcgaattgggacagctcagattcgtgactaaatttcaccacgtcgatcatttgcttgatgcaaaacataacggaaagactaggttcagattcagcatcaatgccgattatgtcattaagaactttgaaccgggaacttctccgctcgacaaacggatcgaagccgccgtcaaagtcgctaaagcgggctatccgctcggtttcatcgtggcgccgatttatattcacgatggctgggaggaaggctataaggagctgtttgagaaattggatgcggcgcttgatgaagacgttcggcatgacatcacatttgaactgatccagcatcgttttacaaaaccggccaaacgggtgattgagaagaactatccgaaaacaaagcttgagcttgatgaagaaaagcgcaggtacaaatggggacgctacggaatcggcaaatatatataccaaaaagacgaagaacatgccttaagggaaacactcgaatcttatatcgaaacctattttccgaaagcgaaaatcgaatattttacgtaaggcagagctgtcggcatgacggctcttttttttgctgcgccaaatgacggaaatgtttgatatttatttcaagatttattcattttcttggccgaaagaccgatataactctcaggaggggatggttatgtttaaaaaaatgcatatcaaaattgctgtgtttgtctcggcaatgcttattgtaacggttgtttttttaacggtttcttcatatttgacattaaagccgatgatgacggaggaagcaaaacgtacgacagagaatgtcaccaattcactcggtcagaacattgagcttcagctgaaaaatgatgagaccgtattaatgagattagcagacggtgaattgtcccggtcttttctatcagatgggaagaaagaaaccgcgcggctttttaacgatgagttaaaacagatcggacagaatgacaaatatgtcgcgcttgcgtacgtcggaaccgcaaacaaacaaatgtttacatatccaaaggccgattttgccaaagactatgatccgacaaatcgaacgtggtataagatggcggctgaaaaacccgataaggttgtctggactgacccttataaagatgcagtgacgggagacatgatcgtgacggcgtcaaaagccattcaaaacagcggaaccgtcgtcggagtggcgagcttagatttgaagctgtcctctattcagagcatggtcaacgagcaaaaggttccgtataaaggatttgcctttttagcggatgaaaacggctctcttctggcccatccggcaaaacagggaaaaaatatttcggaagatcagacgttaaaagacatcactgcggacaaagaaggcatcaaagagctgcaggggaacatggtcgtctaccaaacggtaaaagaaacagggtggaaagtcggaacgcagtttgaaaaagatcagctgatgggagtagccgacaaaatgaacacggtgagcatttttatgtcactgatcgcccttgtgattacgatcggactcagctatttcctcgcaaaaacgataaccgggccgattcagcagctgatcgcaaaaacaaattcagtctcagcgggagatttaaccgtccgcgctcagacgaaatcaaaagatgaagtaggcgagttaacaaaagactttaaccaaatggttgaaaatatgaaagagatggtcgaacaggtcaaggcctcctcagaaaatgtgtctgatacatctgaccagctaaccgtcatttcacaagaaacaaatgaaacgagcggacaaatcgcaaaagcgatagaggaagtcgccgccggagcgacagagcaagcgtcagaggttgagacgatcaacgaaaaatcggaaaatctctcagtcaaaataaaaggaatcgcagatcgcgcaggcagcataaaacaactctcaaagtcttcagaggatgccagctacaaaggactggacgcgctcgggcagctgctgatgaagtcaaacgaagccaattcagaaacgaaaaaagtagaggcaatgctgaatgacctggaagaacaaacgaaaaacatagaagaagtcgtgacggcaatatctgctatttcagaccagacgaatctcttggcgctgaatgcgagcatagaagccgcaagagcgggagaaagcggacggggctttgccgtcgtcgcggaagaagtccgcaagcttgctgaacaatcagctctttcttccggccatatcagtgagacggtccgtctgattcaatctgagacaaaagaagcgtcacacgcgatgattgaggcaagcagaatgaatgatgaacaaaacagcgccattcatgaaacgggtgaggttctcaatctgatcacgacggaaatgcagtctctcgttcaaggtatagatcatatttacaatgacattcaaaaaatgagtgaagaacaagccgcgattcaagaagcgattcaaagcatctccgccatttctcaagaatcagcggcagccgcggaagaagtgaatgcttccactgatgaacagctcgttacgcttgaaaaagtgaagcaatcgactgatatgttaaagagcgcaagcgaagatctgatcagcgccatttctaaattcaccttgtaacgcggactctatcagcctataatatggtaatatagacatgaaagagtgatatatgaatcgcatcaggggaggaaagcgcagtgaacaaaacggtcggatttatcggtttgggcgtcatgggaaacagtatggcatcgcacattttagaagcgggctatcctgttttagtctacacgcggacgaaacaaaaagcggaagagattctgaataagggagcggtctggcaggagacggtcaaagacctttcagagaaagctgacatcattattaccatggtcggctatccgagtgatgtcgaggaaatctatctcggcgaaaacggcattctccggcaagcaaaagaaggggcgtttgtcattgatatgacgacatcaaaaccatctctggcgaagaaaatagcggagaaagccaaagaaaagtccattcacgccctggatgcacccgtttccggcggagacatcggcgcgaggaacggaacgcttgccattatggccggaggagaaaaagaagcgtttgaagcatgcctgccgcttttctctgttatgggggaaaacattcagtatcaagggccggccggcagcggccagcatacgaaaatgtgtaatcagatcgcgattgcagcaggaatggtcggagtggctgaagcgatggcttacgcggaaaaatccggtctgaacccggaacaagtgctgaaaagcattacaaccggagcggctggcagctggtcattgtcaaacctcgctccccgtatgctgaaaggcgattttgcgcccggattttacgtgaaacactttattaaagacatgggcattgcccttgaagaagcggagctgatgggagaagaaatgcccggattggcgcttgccaaatcattgtacgacaagctttccgcgcaaggtgaagaaaacagcggaactcaaagtatttataagctttgggtgaaataaaaaaaagattgcccgcaggggcaatcttttttattatttattttccgataaattgctgtgtccagatgtttcctgattctacataaccgacaccgatttgagtgaactcaggattcatgatgttctttctgtggccttcactgttcatccaagctttaacgacggcttcaggagtcgtctgccctttggcgatattttcaccggcagttttataagtgattccgaaagacttcatcatatcgaaaggtgagccgtaagtcggactttggtgatcgaaatagtttttgtctttcatatcttgtgattttgcgtgagctgatttgcttaatttttcatcaatctgcagaggttttaagccttgcttttgtctctctgcatttgtcaattcaacgactttcttttcgtacgcactgactgatgaaggagttttctcgctgctgttgtttgtgttatctgtctgctttgcattgtcagccgtctggttttgatcggctttcggtttttcggcagctgtcggggccgtttttgccggtgtttctttttgaacgtctttaactgtcatatcagaatgctttgcgtgtttttgcagcagctgagtcagttctttctcatttttaacgttcagctttttcacgctcgttttcatatgtagtttttcaacagcctcttgaagagtcagatgctgtacagtgtttccttttttcacggtaacgacgtgctggcatgacagctctttggcagatgcctgctgaatgcctccgaatgtaatcaaactgactgccgcggcggcagataagagaaatgcttttttcatagttaatagcctcccagagaagtttttttctacatgaaaaatcttatcacagcttttttgtcataatgcagccagccatttcctttgacaacaaactcttgtcataattgtaattgagcgcagaaaaatggctctataccgggaaaaacgatctgtatttattttttaaaatccgttacatctcttcaaattatttgaagtgttagatatattttaagataatttgatcttgacagttttttttacccgttttcgctgtaacaacttttacaaaaatgttacaattaaaatctgtttatgtaaatatattcaatgatttgagaggtgtaacagaaagtggctgaagttgcgcgcgaaccaaagaaaaaaacgaaacgttacagagcgctgagaatgaatctctattttttgattgtttttcttctctttacggcactgatttttaaactcggcatcgtccagattgtcgaaggggataaacaccgccaggatgcggagaaggcaaatgcaaaaaccgcctattatccgacaccgcggggaaagatgtatgacaagcggaacagggtggcggttgataaccaggctgtgcctgaaattgtatatgtatccacctcaaaaacctcggcaaaggacaaattgaaaacggcaaaaaatctcgccgcactgattcatattgatactgaatttatgaaggatcgaaatatcattgattactggcttgccgcacatccgaagaaggcggaaaagcttatgaaggattcagaaaacagcctgaagccgcaagaagtgtacaaacgccagattgaacgcgtcccaaagcaggagattgatgcgatcaaacaaaataaaaaagagctggaaatcgcggcgatttatacgcgtttttcaagcggcaacgcctatcagccgcaagtcgtcaaatcaatggacccgaataagctgaacggaaacggaaacagcgggtcactgcttgacgaacatgaaaacaacaaacagaaaccgaaaagcgacctgacatatgaagaagtttctgtcgtatccgagcacctgaaagagctccccggcattgacgtaattaatgactggacgcgtaaatatccgtacgacaaaacactgtactctctgttcggcggtgtgacgacaccggaacagggattgttgggcgaacggaaagattattatgttacaagaggatactcactgaatgaccgggtgggaaaaagctacattgaatatcagtatgaagactatttaaacgcacataaagaaaaagtagagtatgtggaaaacagcaaaggtgaagtcgtcagccaaaagcccgtcgatgaaggcagcagaggctacgatctgcagctctcgctcgatatggaattgcagtcgaaagttgaaaaagtcattgaaaaagagctgagaagaagccgcgccgcaggcaactatatggttgacagaggatttgccgtcatgatggacccgaacaacggggatattctctcaatggcggggaaacgcatcgatctcgaaacaaataaaatacaggattttgcgatcggatcatttacgacacaatatgagatgggctctgctgttaaaggagcgactgttctcgcgggttaccaaagcggcctcccgcattataaaacatttgtcgatgcaccgcttgtatttaaaggcaacacgagaaaacaatcgtggacacaaatgggagccattactgagctgaccgcgctgcaaagaagttcaaacgtatatatgtttcatgtggccatgcatatcgccggcattaactacaggccgtacggtacactgccggccggattagacgatattaaaaaaatgcgcaactactacgcccaattcggtttgggtgtgaagaccggaattgatcttccacaggaatcagcgggcatgcagtcaaatccgcaaatggtcggggggttgctgcttgactttgcgatcggacagtttgatacgtatacgccgcttcaaatggctcaatatatttcagccatcgcaaacggcgggtatcgcgtccagccgaggatcgtcacaagcattcatgaaccggacagcaaaaacaagattggaaaagcgattgaacagcgggatattaaaattttgaacaaagtaaataacagcccgagcgattttgatcaagttcataaaggaatgaaactggtcacaagctcacctcaaggaacggcttattcaacattccaggggtccggcgccgatgtttccggaaaaacgggaaccgcggagacccactattacggcacgaacaaaaactggtgggggaaagacacgtataacctaacctttgtcggctattatccgtcagaacatccacgagtggcattcagcgtcgtcgtaccgtctgttcgagatgatcacgatcccgtcagcaaaaacattgccaagggagcaattgacgcttacaaagaacttgaaaagaaatacaataaaaaataacaaatgaaagggcggccgaacatctcgtgcgccctttctttcattcaggaaaattgacgttcacaataagaatagaaggagaatgctcattttttagcgaatcaatctagtggaatttctttttatatcagtccgtgtccagcctgcagtgcgagtataatgcaaaggagggattctgtggaacaggatactcagcatgtcaaacagtttcaatcgaaaaccgatcttcatgccgttttgacgtctaacgggcgtattatgtatatttctgcaaactgcaaatcgtacttcagttattctcaggaagagatgatcgggtcatttctcaaaacattcctgcatgaagaagatcaatttttggttgaaagttacttctataatgagcatcatttgatgccttgcacctttcgtcttattaaaaaagatcataccatcgtatggcttgaagcgggtgtggaaattgtcacaccgcaaatggaggggacggatcgggaaatcatcctcaaaatcaaggtgcttgaggagaagacaccccgccggccttatatgtatgaacaaaagaagcaaaaggcagaacaacagtcggaagatgcggctggaaacggcgaattcgagcgtcttgtcgaaatgctgccgaatcctttatatgtcagcatcaacggcacaatcgcctacgccaacaacgcgatgcttgccatgctgggagccgaaagcaaagacgaggtaatcggcaggcgctcttatgagtttattgaagaagagtatcacgacattgtgaaaaaccgaattgtgcggatgcaaaaaggaatggaagtcggaatgatcgaacagacgtggagaaggctcgacggcacgcccgttcatttagaagtgaaggcggcaccgacgacatataaaaatcagcgggcggaattgctgcttctgattgatatttcttcacggaaaaaattccaaacgattctgcaaaaaagcagagaacgttatcagctcctcattcagaattcaattgacacgatcgccgtgattcacaatgataaatgggtattcatgaatgaatcgggcatttcgctgtttgaggctgaaacatatgaagatttaatcgggaaaaacgtctatgatcagcttcatccctgtgatcatgacggcgtgaaacagcggatccaaaatattatcaaccgaaagaccgagtcagaaatcattaagcaatcgtggtttacctttaaaaaccggctgatctacacggaaatggtctgcattccgacgacgtttttcggagaaacggccgtgcaggtcattctgcgtgacatttctgagcggaagcagacggaggaattaatgctgaagtcggaaaagctgtctatcgcagggcagctggcagcggggatcgctcacgaaatccgcaatccgctgacggcgatcaaaggatttttacagctcatgaagccgacgatggaggaaaacgaacattactttgaaattgtgttttctgaactgagcagaatcgaattaattttaagtgagcttttaatgcttgccaaacctcagcaaaacgccgtgaaagagcgtgtaaacttaaagaaaattataagtgaagtaaccgctcttttagagacgcaggcgaatcttaaagggatttttatcaaaacggattacgaacatgacagcatgtatattaacggtgatcaaaatcagctgaaacaggtgtttatcaatctgattaaaaatgccgttgagtcgatgccggatgggggaacggttcacatcatcatgacagaagatgagtattccgttaatgtgacggtgaaagacgagggtgacgggataccggaaaacgtgctgaaacgaataggcgaaccgtttttgacaacgaaagaaaaaggaaccggcctggggctgatggtcacattcaaccttattaaaaaccatcagggagccatccaagtagacagcaaaccggacagaggcacggcctttcacattacattcccgaaacaataaaaaaacaacggcgttatgccgttgtttaaatagtctgcatggattctctcgtttttaaaataaatgcttccagccggtccaagccttctctcaatgtatccagtgaatatgcgaatgacagcctcacatacccttcacccaattttgaaaacgagctgccgggcacaagagccacacctgcatcctctaaaagagccatactaaaatcaaacgatgacattccgaatgacttaatggaagggaagatataaaatgcgcctgacggctttacgacgtcaagccccattgagacaagacggtcatatacatagtcaagccgctttttatactgttctctcataataagcgcatcatcaacaccgtttgtcaccgcttcaagagccgctttctgagagattgaagacgcgcatgtcacactgtattggtgaacttttaagatgtgcttggcaatttctttcggtgcgaaaatgaaaccgattctccagcccgtcatgctgtgtgattttgacaggccgttgatgacgatcgtctggtctctcaaataagacgcgatcgaataatgcggtctgtcataggttaattcgctgtaaatctcatcagacaggacaaaaacatttctgcccttcaggacggctgcgatgttttgcagctcttcctcagacaatgtcactccggtcggatttgacggataaggaagaatgacgcattttgtttttggtgtcagcgattcttcaatgagccgcgccgtcagcttaaatccgtgagtcgtcgtatctacatggaccggaacggcgcccgacatgcggatgatcggttcgtagcccggatatatcggcccggggagaattacttcatcgcctggagataaaatcgtccgcaaagacgcgtcaatcgcttggcttgccccggttgtgacgatgatttcagtttcagcttcataattcaaatcagcttttttcttcatataaagctgtacggcctgtctcagctcaaggccgcccgcgttcggagtatatgccgttgcgttctcgtcgattgcctttttggcagccgctttgacatggtgcggcgtgaagaaatccggctggccgatcgtaagcgaaatgacattgtcgtgctgagctacaagatttgagaatttgcgaattcctgaaatttcaatttcttttacattcggattaagcaaatgttccataattcatcaccttatactatatattgagtttatcctattttaccactagctgagcatttgtcatctttttattgaactatcccgagtatatgtccgatatgtgaaaacataccttctttcagaaaaaaataagacaaccagctgaaatgattgtcttcattgtatcatgatctatctattgtgatatgtggcgaatgtcattaatacccgtattcaaagctgacgtcttcccgccataagatgtatggagcaggcttgtcgggacgatctttcgcctcttttttcatttgcaggtaagccgttttgctgatatcttctaacaccatcatttgatcttggtcgaatatgactactgtacccatttattacacccttcttcctgaaaaatccttgactattttaccactcgatgtcaaaaagtcaatgggatatcagaaaaaagcatctttttataaagagttcatggccagttggcccgaatacattcactttttccgtttacagccgatatatacagtacaatactgaatgcggatagcgagggattgaattgtctttacaacaatacgatattttattggattcaggcacaaacgaattagaaatcgtcaaatttgaagtaggcgtcaatacatttggcataaatgtgatgaaagtccgggaaatcattcagccggtagatgtcacatctgtgcctcagtctcataaagacgtagaagggatgattaagctgagaggcgaaattcttcccgtcatcagtctgtatacctttttcggcgttgatgccgaaggagcaaaagacgataaatatatcgtaacggaattcaacaagcggaaaatcgtctttcacgtcggttccgtttcacaaatccacagggtgtcctgggaggcgattgaaaagccgacttccctgaaccagggcatggagcggcacttaacgggaatcatcaaactggaagacacgatgatctttctgcctgattatgaaaagatcatttacgatattgaatcagcatccggtgttgagacttatcatgtccatcaggaaggatttgatgaaagacgggcgggtaaaaaactgattatcgttgaagactcgccgcttctgatgcgtcttttgacggatgagctgactgaggcggggtacagtgaaatcgttgcgtttgaaaacggaaaagaagcgtatgattacgtcgtggaactgacggataacggagcaaacctgtcagatcatattgacatgattatcagtgacattgagatgccgaaaatggacgggcatcgtttgacgaagctccttaaggataacccgcaaagctctgatgtgccgattatgattttctcgtccctcataacggacgacctgcgccaccggggcgaagtagtcggagcggatgaacagatcagcaagcctgaaatcagcgagctcattaaaaaagtggatacgtacgtgattgaatagaaaaaagccgatgcatgacgcatcggcttttttgcggcggaattaaaaataactctcaccaagttttttaaatacgggtttatgataagcgggctgctgcctgttggcggcaagcggtttttcctttaagcccacatatttttgcaatacgtttttcgcttttgtcaaagacatttgtgctttaggattgcggtacgattgatttaacgtacctaaatgcggaagatgctggaagtcttcttttgttggaggcatgtgaaaatagtagtctccgatagagataagtacgtctgactgctgttggctaaacctgggattatttgaaaagtgaagccctatttttttccctttgccttctttcacaagcttttgtaatgcccgttttttcagcagataaaggtatttagggttgggggcggtttttgcatggcggttcacagtataaacagcttttgaaagattctcgatggttggctgcagctctttcgaataagcgtggtcgtccattatttctctcctttgcattgatcaagttcatatatagattatacttttttagcgttgaaatgcaaatattgattataaaaatacgcctttttctgatgaaaagggcgcatttttttcctttattagacaggtttcgcatgtttttcggaatcagcctttaatgattgctgtacatcgacctctgctgcctcggcgctgtatttcggaagagcgataaaatagaacacaaataccgctaaaatcacgattcccatgccgtaataaaggtaatcaatattggcaacgaatttcggaaataacagggcaaccagtccgagtgtaatcgattgggcaaacatcataaaagggtcctgccagccgctgacccggcccattattttcgggtgaacgattttcggcatccagccgccgatggcgatattgacggggccgatgcacatgccgaggatgaaagccgccgcataataaatccacagcttatccgtatagccgaggacaaaaatgagcagtccggctgccaaaataggaatcgacatcaaatgatgcggtttgactttttttgcgatcatcgttccgatcacacttcctgcaagcaggccgaagccgagtgcgacggtgaagatggaagtatgtgattcataatggtccggcgcaagtccgtatttcatcgtaaacatcggcagtacggcaaagccgccgttgacaaaaccaaagataaaaaagccgaaaataagggaagcaagcaatttgtttttaacaatatatacgatcccttccttaaaatcagcgaccgagtctttcagaaacgaatctccccatttaaaagggccgttcggctgacgggcttctttcggaatgcggcaggcgcggatcagaaagcctgatacaataaagctgacaaaatcaaggataatggctccgtgcataccgatcgttttatacataaacgcgcccataccgacgccgaataccataaagatgctgaacaggatctggttaagtcccgccgctttcgcataatgctccttaggcagaatagcttgtacaaggctggcttccgccgggaaaaagaacttggtcacggcgcttctgatgaacaaaatacagaacacgagagggatgctcccagtgtataatgcggcaaacaatatgatcgtcagtccggctctgatccagtcacaattctctgcgacctttttcctgtcaagccggtcagctgcgacaccgacaatcagaaatacgaaaactgtcggcagtgaatacatcagctcagccaaagttgtgtatgccggctggtttgaaaaatggtccagcaagtaaaaagcgaaagccatattacctacagtcgttcccatttgagaagcgagtgctgcgaaaaagagacggacaaaattgcgatttttaaatatatccataaacacgctccttaccctaaaggtcccactgtaatatattatcatcagctcgttccattaacaaataagatctttctatcttataatggtcacccttgttccattaggcacggtagcggcaagttcagtgacgtcctgattatacatccggatgcatccttttgataccgctttgccgatggaggaaggattatttgttccgtgaatgccgtaatgaattttagagaggctgagccaataagcgccgaacgggccgccgggcttaggctggcggttcacaatgtaaaattctccggtcggcgtggtcgtcaatatttttccgactgcgatggggtacgtacggatgagcctgccaaggcggtataactccagtttcttcgctccgatatacacgacaatggaataggggatggtggatgggtcgggaagattcggtatgataatatgctgtcccgcgtatatgaccgattggattgagggatttgcctgaaggagagcagcagtgcttattctgaagtcttgcgcaatgcttgagatggtttctccttgtttcacttgatatgtcagcagtttcatcaccctcctttttgctcttttccatatacatattacggagggggtgtctgtgcatcgggataaaagtcttatttttgtacggttttcaatgtgaacagcgtgatttccggtctggctaaaaatcgatacggcagtcttgtcgtaccgagcccgcgattaacgtaaacggttgtgtcatgcagcgtatacatgccgtcggtatacgtttttccgtatggaggcgtaatgagagggccgaaaaacgggagctggacctggccgccgtgagtgtgtcccgacagctggaggtttacgggatatccgccgatcttgagagcggcatcaggctcgtggacgattaaaatggaaaacgcatcttcggaaaggcgggacagggtgccttcataatcgggttttccgagcattacatcatccaaaaacgcgagttcaatccggcttccgtctgtcagctgcacctgatggcagccatttcgaagcacttgaaaatcagccgcttccatcagagccttgtacgtgttcgtaccgtagcctccgtggtcatggtttccgtaaacacaaagtttgccgaagggagcttccagattttgcagcacggcgagtgcttgctggtgatcattaaataaatgcggcttatcaattaaatctcccgtaaagatgagcagatcgggtttcagctgattgatcttttccgctgctttattcaagtcaccggatgtaaacacatcactgagatgcgtatcgctgaattgaacgattttaaaattgtcaaagccgcgggggatcaggcggttggtgattgtatgacgggtgatctcaatcatgcgcggttcaatataccgggcatagccgtaacctccgcaagccgttgcaagagttgcacccaaaatgccgaatcctctttttaaaaatgttcttctcgtcattttctccatctgtaaaaccaacctttgtcagagttgttctattatatcatcagcctggctgaaaaatcccttctcagcatgtaatgacgcggaaagacatctatgataagattatgaatgattattcattcaatataagggggtttgttatggataagaaagcggtaatcattacaggcggttcaagcggcatgggaaaagcaatggcgaaaaaacaggctgaattaggatggcacgtcatggtgacagggaggaaccgtgaagcacttgaggaaacaaaaaaagaaattgagacctttgaggggcaggtcgcctgttttcaaatggatgtccgttctgattccgccgcttcagacatgattacagaagcgaaaaaagtctttggccggctcgatgcgctgattaacaatgcggccggcaattttatttgcccggcagagaagctgacgcccaatggatggaaagctgttattgagattgttttaaacggcacatttttctgcagccaagccgcggcaaggcattggatcgagcaggagcagaagggcgtcatcttaaatatggccgctacatacgcatggggagcgggagcgggtgtcgttcattccgctgcagccaaagcgggggtattgtcactgacaagaacgctggccgttgaatgggggagcaaatacggcatccgcacaaacgcgatagcccccggcccgattgaacggacaggcggtgcggagaagctgtttgaatcggaaaaagcggtgtcccgcactatgaacagtgtgccgctcggccgtctggggacaccggaggaaatcgccgctttggcagcgtttttgctatccgatgaagcatcctatataaacggggattgtatcacaatggacggggggcaatggctgaatccttacccgttttaatttacatgacatattttgcgaagcaagcgaacgttaaaggtgaacgttcgcttgttttatttttctattcaaaattatgatataatttttaaagattaagaggtgaataagtgaagaaattattaaaatggttcgttgtactatttttaagcagttgcgttatcatctttaatatttggtactttatcatttgcgcttttactccggagtattatcaaaataccaatcttacatctgatgaaataatcagatttgaaaagctatatcatatagattttcctgatgaaacgaaatttattaaagccagggagtatttgagtgggctcggaggcgatacatcggctgtatgatatgtgtctctgccaaccaagctggcggaaacaattttatctgattatacgtatatgccaataaatcatactgatcatgccggttcaatgtatggagttgacgtttccaagagtgctggcgggttaacaactcttacatttggcactttagataaaaaaggaactttctttcagttgaaacatgatgatgattggatatttaacagtactgattggagccattatttttggacagccgccggttataatgctcttatatttatccttttatttgtgatggtgaaacaaatgaataacgtccttaattaaccggtctgaagagtgatcttaaaaagttttccccttttattttaaactgctgccatactgcctcctttttcccctaatctaaacatttgtggtgctgatataattgtgtataatcagacaaagatagagaagcaggtgataacatgttggacccacttgatatactgacgaatattgatgatgtcattccgtattaccaagcgatttttaacgctgaggaacaaagagtcgtaggctacgaagtgcttgggcggattttggcagatgcggagattgagagcctcgggccgtttttcttagattccggcattccggaagaatataagcttgaggtcgatgacagagtcatcaggcaggcgctggagcggtttaaagaagctgatcgcgatctgttgatttttatcaatcaggatgcgaatgtattgatgcttgaccacggagaaagctttcttgagcttttgaaagaatacgaagagcagggcattgaattgaaccgtattgtgcttgagatcaccgagcacaatttcgaaggcgacattgaacagctgtaccatatgcttgcctactatcgtacatacggcattaaaatcgcggtggacaatataggtaaggagagcagcaacctggacagaatcgcgctcctttcaccggaccttctgaaaatagatttgcaggcgctgaaagtatctcagccgtcaccttcgtatgagcatgtgctgtacagcatttcattgctggcgagaaaaatcggcgccgcgctgctgtatgaagatatagaagctgattttcagctccagtacgcatggagaaacggaggccgattttttcaaggctattatctgcaggcgccgagcggcgattttatagaccggagcctgttaaaagcacgcttgaaaacggagtttcagcaatttatcacgagagaaaaaaagaagctggagacagtatacgaacactctgagaatttttataagcgggtcaatcaggcagtttccgagctgaagaaaacccatcaggcggacgatgagtttattaaaaaactggcggaaaacctgaccgactgctgtttcagaatttatatgtgtgatgaagaaggctatcagctgacgggaaatgtgttcaagcagtccggcgaatggctttatcagcctgaatacgtggagaaaaactggagctggcgtccgtactttttagaaaacattatgaagatgcggaattcaagaaaaggctttttcagtgacctgtacagtgatattgagacgggtgagatgatcagaaccttttcatacccgatggatgacaatatgtatttatttatcgatctgccttactcttatttatatgaacaggacgggttactttaaagcggctgctgtatgccgcttttttttataaatgtgaaaaagttttaaaaaacgattgacaatgatagtgataatcattatcatttagttatagagagaagttactctctgttccccaacccctctatcagatcaagatccgaaaaagcttggcgctacccccgccaagtttttttatgctgtctcctcataaaaaggcttctcctcacatacatctgacaatggcggctcaaaaagcgaaaaattatttttgaaaggtgtatgacattccgaaaaaagcttcaaactattcgaaaacacagttttcccgtttattttcttattgaaaatccagcgggaaaatgccatcccggtctactttatggtatgatgctctgtaggacttgtattataataaatacttgttgatttgaagttgttttttgaaaggagtctttttttagaatgtcacaattaatgggtatcatcacgcggctgcaaagtctgcaagaaacagcggaagcggctaacgagccgatgcagcgttattttgaagttaacggcgaaaaaatttgcagtgttaaatatttcgaaaaaaatcaaacgtttgaactgacggttttccaaaaaggtgaaaaacctaacacgtatccgtttgataacattgacatgatttctattgaaatttttgagctccttcagtaatgtgatttgatttttcaggctgaccaagcttccggtcttccgcaagcggagctttattaaatcatgcaaaggaacgtgcttgttcgtttggttgtagactctggaaagaggagtgtccgtacatggctgattcttttctgttttataatctttctgaggcacagatgacctttcaagacgtgacggagcggctgaaacgctttgtcaataaagacccccgttcagcatacgtgctgtctgtagggacggattcacaagtttaccgcgacttcacaaagtttattacggctatacacttgcaccgtacaggcaagggagcttggggctgtttgaaaaatcacgatcttgcaagaccgatacatagccttcgcgaaaaaatctcgctggaaaccgcgttcagccaggagatggctgcgcatatcctcgacggccgtcttatggaactgacagatttgctcttgccttttgcggatgaaggggcggatctttcatttgaagtgcatctggatatcggtcaaaaagggctgacaaaagaattgatacaagaaatgaccggccgcattacctcgatgggcattgaagcgaaaatcaagcccgattcctgcacagcattcagttatgccaatcgttacacaaaataatatttcatacagaatccgcaaaatgtcgaattatgcggttgacgatttttttctgtttacttattctagcggtagagctgaaagcaaatttcaccttgctttcggaggtattcagttaaaaatagggggcctgattacgtatgagtcttatcggtgaacgatttacggaagaagaacagaaacttctgctgaatatcctgatcaatcaagaatatgccattgagcttttgaccagcgaaatcaacgatatagaagcagggtcaaaaagcgttgatggaaccacttataaaaaactcgtaacgctctatgaccgttttcggaacgaaaattaatcagcggcctataaattgatactcgattgcaaagagtatcttttttattgacggaaacttttcgacaaaaaatgataatgtttatattattgcaatatagggaatacatgctttgatgaaaaatgtaaaggggtcgaagtgacatgattagcttacaatcagatcagcttcttgatgcaacagtcggacaatttatgatcgaggcggataaagtggcgcacgttcaagtcggaaacaaccttgagcatgctctattagtgctgacgaaaaccggctataccgctattcccgtccttgacgcttcgtaccgtctgcacggtttgatcgggacaaatatgattatgaacagcattttcggacttgaacggatcgagtttgagaagctggatcaaattacggttgaggaagtcatgctgaaagacattccccgtctccacatcaatgatccgattatcaaagggttcagcatggtcattaacaacggctttgtctgcgttgaaaatgatgaaggcgtctttgaaggcattttcacgagaagagtcgtattaaagcagttgagcagtcatatcagatcattgaataagtaggctcgcacgatcagcctatttgttctttcgcatgccagaaaaagaaaacgcatacatatgagtggcgcttgcctcggcagcctttatttgattagaatggtagataagaaatatgaaaaggcattgaaaaggaggacgacatgcagcttcaagagcttcatatgctcgtagttttagctgaggaattaaacatgaggaaggctgccgaacggttattcgtgtcacagccggctctgtcccagcgattgcagaccattgaaaaagcctggggaacaaagatctttcttaggtctcaaaaaggacttacggtaacgccggcaggagaaaaaatcatacaatttgcaaatgacgtcacggatcggcaagaaagaatcagagaaaacattgatgaacttgagggtgagattcacggcacattaaagcttgccgtcgcctcgattatcgggcagcactggcttccgaaagtgttaaaaacatatgtggaacgatatccgaatgcaaaggtctctctcattacagggtggagcagcgaaatgctgaaaagtctgtatgaagatcaggtacatatcggcattatccggggaaatccggaatggaaaggccggaaagattatttaatgaccgatcatttatatttggtcgatacggaaatttcctgtattgatgatattgcccataccgatcggccgtttattcaattcaaaagtgacagtacatattttcaggaaattcagcattggtggcatcaaaaattcaaaacttcgccgaaacagaccatccttgtcgatcagattgaaacgtgcaagcagatggcgctgcacgggatcggttatgccattctgccgtcagtcaccttagaagaggaagacaaagtaaataaaatgcccctgcttgatacaaaggatcatcccatcggccgtgacacatggctgctcggttatgagccggcatttgaattaaaacaggtgcaggcttttgtttctgtcattaaagatatgctgaaacaggaacgcccattttagaaagacagcaatcatgctgtctttttttattttttattgacaatgaaaatcattatcatttaaagtgttatatatgttaatgaaaatcattatcaattacgaggtgatcatatgcagaaagcattaatgatatacgcaagcatgtcggggaatacagaggatattgccggcattataaaagaaacactgagcgggcatcagatagcggttgactgtcttgatatggacgaagcagatgcggattctctcaaagcatatgattatgtttttgtcggcacatacacatggggggatggtgatcttccttacgaagcggaagatttttacgaagatattctgcacagccagctcaacggactgaaaacggcctgtttcggttcaggcgatcacgcctacccgaagttttgcgaagcggtcacgctgttttgcgatgcgtttgaacaggccggagccaatttatacccggaaacgctgaaaattgagctggcgcccgagacggctgaagatcaagaatgctgcaaagaatttgtccgcggttttcttgcatgggccgctcaccacggagaccggtaccatgtttcataaaggcgcgacggctgtcatggcatcagtatcttcgggattttttgtcgctgtgaaagacgaaggtatttttcatttttcggcggaagaaggctggaaaagactattccgagtgaaaagcaggattcatgtgctgacttatatagggccctacatattcgcagctggagaaaaaggcgccgtcctcagatcggccgatcaaggaaagacttggacggcctcccgatttccgaccagcgcctccgtatgggccgttgccggacggaatgacggatttgtctgtgcgcacggcacatactgcctctacttatctgatgatttcggcgtcacttggcatgtggctaagcccttttcacaattaaaggagccgcctgtcatccgttcgctttgtttacacggtcagacgatttatatcggcacccggattcatatgaatcatggcggcatttgggcgtatgatctgacggaaggccgcatccggcgtataagccgtgaaaggcagcgcatgacggcttcaatgatgatgtatcagaatgactggctcattgcagcaaagggcgcggcaaagggagaacggggggaggttgccgttcgaaacgtgcggacgcaagaggagtttgccattacagccggggacgctgtaagggaaaagtcatttctcgacgtttctgaggataacgggactatttatgtcacatcgtcacagggcgaaagcggattttcgcgtatttatcaagctgatcttgccgccggtgaattaaagtggtttgatacgatccgcggtcacggatggcgggtggccaaccgggaagaaaactttttttgcgcgggcctttacgaaagtaagtttgtcagaccgtatgaggcggttcggctcgcacattagtttttatgcataaaggagagacgaagatggggaatgtattgcttgtttacgctacaatgtcaggaaacaccgaggcgatggcggatttaattgaaaaagggctgatcgaagcacaagcctccgtagacagatatgaagcgatggatattcatgccgaactttttaatgattacgagtatattttattaggcacatatacgtggggagacggggatcttcctgatgaaatgctcgatattgctgaagatatggaaaacctggagcttacgggaaaaacatttgctttgttcggttccggagatacgtcctatgagtttttttgcggagcggttgacgaattggaaaaagtaatcacggcccgcggcgggcgggtggtgctgccgccggtcaaaattgaaaacaatcctgagggcagtgaggaagaagagctccgggaattcggaagacagtttgccgcgctgtgcagccagccggcagaataaaggcttgttcctttttttcttgtctttgtatccttcctttgttacagtaatgaggtagaaaatcagaggaggacaatacatatgaaaatgatggatgcaaatgaaattatttcatttattcaaaatagtacaaaatcaacgcctgtaaaagtgtatgtaaaaggcgatcttgaaggaatcagctttggcgattccgctaaaacattcctgaacggccaatccggcgtcgtttttggcgagtgggctgaaattaaaagcgcaatcgaagaaaacaaagacaaaattgaggattacgtcattgagaatgaccgccgcaactctgcgatcccgatgcttgatttaaaagatgtgaaagcgagaatcgagcccggcgctattatccgcgaccaagtcgaaatcggcgacaatgccgttatcatgatgggtgcatctattaatatcggttcagtcatcggcgaaggtacgatgattgatatgaacgttgttctcggaggacgcgcgactgtcggcaaaaactgccacatcggagcgggttctgtattagcgggcgttattgagccgcctagcgctaagcctgttgtcgtagaagacgacgttgtgatcggcgcaaatgcggttgtgcttgaaggcgtaacaatcggtaaaggcgcggttgtcgccgccggagccatcgttgtaaatgacgtcgagccgtataccgttgtagcgggaacaccagcgaaaaaaatcaaagatatcgatgaaaaaacaaaaggaaaaacagaaatcaaacaggaattacgccagctgtaaggaatggtttgatagaatgggcgtggatgataaaatccacgccttattcttatctcaaggaggaatacatatggaaaaagagcggctcattgccatccgaagagatctgcaccgcattccggagatcggctttcaggaatataaaacccagcagtacctgctgaatctattaaaccaatatccggaagaaagaattgaaatcgaaacttggagaaccggcatctttgtcaaagtcaacggcacggctccggaaaaaatgctcgcctacagagcggatatagacgctctgtcgattgaagagcagacggggcttccgtttgcatctgagcaccccggttttatgcacgcatgcggacacgatatgcacatgaccatcgcgctcggcattattgatcattttgtccatcatcccgtcaaacatgatctgctctttttattccagccggctgaagaaggaccgggcggggcggcaccgatgcttgaaagcgatgtgctgaaaaaatggacgccggatttgatcaccgccctccatatagcacctgagctgccggtcggcaccatttccaccaaaagcggattgctgtttgccaatacgagcgagcttgtcatcgatcttgaggggaaaggcggacatgcggcatatccgcatacagcagacgacatggtcattgccgcgagcacgcttgtcacgcagctccaaacagtcatatccagaaatacggatccgcttgacagcgctgtaattactgtcggaacgattaccgggggcacggcgcaaaatatcatcgcagagcatgctcatttggagggaaccatccggacgctttccgaggaatcaatgcgtatggtgaaaaagcggattgaagagcttgtcaaaggaattgaaatcggcttccgatgcaaaggaaaagtcacgtatccgtccgtttatcatcaagtttataatacaagcggcctgaccgaagaatttatgcaatttgtcagcgatcatcagcttgctgacgtgaaaacggcgaaagaagcgatgaccggagaagatttcggatatatgctgaaaaaatatcccggctttatgttctggctgggggccgattcatcccacgggcttcatcacgccaagctgaacccggatgaagatgcgatggaaaccgcggtaaatgtcatggttggatatttttcgaagtatgccaattaaatccgaaaagaagaataatctaacaaaaattgagcattctacataacggaggtgttcaatatgacgaaaaaaattggaattgaacaatctttatcggatgtagaacaggcgttaaaacaaaaaggatatgacgtagtgatgatgaagactcctgaggatgcgaagaattgtgactgctgtgtcgtaaccggacttgacagcaatgttcaaggaattgccgatacatcaactcaggctcccgtcattacggcttccggaatgaccgccgacgaaatctgcagcgaagtggaaaaaaaatttcattaaaaagaaaaaaccgaagcttacgcttcggtttttctattcggcggaagcggcgtttttaaaacggtcaagcgcgatttttatttctctccgcagtacgcgttcaacccgccattgctccatattttctgttttggcaatgattctgatcaccatttctgacgtgcttaaatcttgaaccccgatgacgtccggcccttccttaatctgcgggagctcagcggctgctttgtcacacgcggtttgcaggatttgaatggtttcatcaagatttttttcaagcggcactttaatatcgacaagcgcctgcatcgttccgcgggaatggttgctcacattcgtgatgccccggttgggaagatagtgaagcgtgccgtcaaagctccggatttgcgttgtacggagaccgacctgctcgacaatgccgctgtagccggcaaccgtaatataatcaccgacgtcaatctgtttttccaaaaggataaaaaatccggtgacgatgtcactgacaagcccctgagccccgaagccgactgcgagaccgaccacgccggcgccggcaatgagagcgctcggattgtagtgaaataaatccaaaatcatcacgataaaaacgaatatcaggatgtatccatacacattgagcgcgaggcttcgcaaagtataagcgcggcccgtggagaggttgttttgttgctcgaatttctgaaacagatgcttgatcagcttttttcctgccgtccggaaaataaagtacgctaaaataatgagagccagctttatgatgaaaatcccggcagatgtgagaagcccggcccaatcaaagtgttttaaatcaatcatagtgatgtcttcctttcaagtctattgcagaaaaagctaaaagtgatatacccgttttttaaataagataaaccttttcatagaaaccagttattacatttatgatttgttcatattgccccggtttcaatatcttcatttttgtgaagatatgtactaaagaatctccacactcattttaacatggtgattcagccaaatcatatcctttggagagaaaacaggaggacgttgcccggcggactgaaagccccggcaaaaaactttttcataaggagggaaatgagatgaaattacatcagcaaatgcctgaattgtccggcgctaaagcatggattaacagagaagtcacgaaggaacagctggtcggcggaaagccggcactgattcacttctggtccgccagctgccgcatgtgtaaagaagcgatgcctgaggtgaacgggtttcgtgataaatataaagatcagctgaatgtgttggccgtccacacgccccgttccgaagacgatcttgatcttgagaaaatcaagaaaacagcggctgagcacgatatctctcagccgatttacgtcgacagcgatcatacgctgactgacgtatttgaaaatgaatatgtgccggcttattacgtttttgataaaaacggacagctccgccattttcaagcgggagagagcgggatgaaaatgcttgaaaaacgcatcagccgggtactttcagaaacggagcaggcttctgagtaatcgggacaatctccgtcggactattgtctcggttctgcaaaccctttgccgttaggtaacagggtttttttgtgtctattggataaaaaattccaatatgacatgtgtggcttaaaaaataagagaaacagcggtaaacacgctgtaccgcttgttttatccatatcattatcttttacatattatagtcgaaaattgtagatatcacgctaattttcattaaacaagtaatttcaagttatattttgaaatggttgaataaattggaactttgtccagaatcccctatatgataagggatttttgtatataaagtaccattttcagaaaataagcaatttttcatagagtaaataaaatagtaaaatgataaaataatagttgataaaattacttttgtaatctaatatcttaataaaagcgtttaaatttttgacagggggttttacacatgtttaatgaaagagaagcgctgcgcttacgtttagaacaattgaacgaagcagaggtaaaagtcattcgtgaatatcaaatagaacgtgataaaatatatgcaaaactgagagaattagacaatacgggcagcctgtccgatacaaaaaaagagtttcgtccggagaaaaaaaatgactccctcccggtacttgcagagcttgcagcacaggaaatgagaagctatcaaaagccgcagacacagcctcaatcctcccagcagcagatgcagtctattacgtctcttcccgcaggcattccagacggttctacaagaagaagaagagggacggcgagaccgggatcgaaagcggcaaaactgcgcgaagcagcgattaaaacattgaaacgccacaatgcagcgatcaaaagttccgaactgcaaaaggaaattgaaaaggaaagcggccttgaaattcctaatatgacaacatttatgcaaagcttaattaaaatgtatccggaagtgaaaaaaccataccgcggccaatatattcttgagggagaaatttctcaggaaacagcagaaacggcaaatgatacggctgctgaataaaacagtaaaaactgcttgcgttactcaagcagtttttttgcgctttcccgcttattctgcggaagtgacgcatcttttccaggctttttttcaagcttgacaacatatttttggaaaggcttttcgccgtcagcgcgttctttcaacgcatccagtttttcatcaaacgactgatcgcgggactctgattgtacaaattgtttttgcagggagatgacttgttcggtaacggctgtaagcaagtcttctgcctgaacagtctctttggaaacggaagggatttccagagtttgttccgccggttccgccgtgcggctgtcaatatcagcaaaatggccggcaatccaagcatcactttcgtccagctgccgtttatacgaaagaatggtttcttgaaataacttttctttcgttttttctatttctacaagccgttcttttgtttctagtattcgatctctcatatgattaatttctattttaatatgtttgagctggtattctttttctatcatttgtgtttggagccgggtattttcgtctgcagcggcatgataacgctgtttcatatcttcgtgagaagtccgttcggtttgaatggcggtctcaagtgagcggatgcgggtatgtaagtttttattttcttcttcaaattttatatttgtaagatgcagacgatgcttttcttccatctcatttttccgacgaaacgtttcctgctgaagcagttcttgcagaatgacgattttatcgagcagcccggctctgatttcatgcaaagaacgctccgtgtcacttgtctgtttgtgtttttgagccatggcttccaattcgtcagaaagcttgtgaagccgctctttaatattggcgttttcctcctgaagcttattatttttttgatggaagtagcttgcttcaaattctgaaattatttttctgcatctggaaagttcggatttcaagtaaaggttctcttgagaagtgtcgtggaaaaacggacctgatattttcataagaaccatctccctcatgatgttaacactacaatatgggaaaggaacaacggctattcctcttaattaaacagacaagcaacgtaatattgtatttcggctgaggcgtttgctatgcttttatatagaatgggagagagatgacatgaaacgggtgaatgtaatattagcggggggagcttcccgaagattcggagaaccgaaagcttttgcaaagtggaagggcggcatgttttatgaacaggcgaaaaaagccttcggcggcggagaaacggtaattatcagccgccctgagcatataaaaaagttcttatcaaacagggagcggcatgtttttgccgatgagccgcggtttcggggaatgggcccgcttgccggcatatatacggcaatggaacaaacggaaggcgaaacatatacggtcatatcctgtgacacgccgctcgtgacaagaaaaacgatggctgcgcttgaaatgaagctgaccggaaacctggacgctgtcataccggtttgtgaaaacagagagcagcccctcttggcggtttaccataaacgggtgcaggatgtgctttttgatcagctgacacaaaacaaactgaaaatgacagacacgctgaaacggctgtctgtctgttatgtgcaggctgaagacatcggcgccgggccggaggagttcgctaatgtcaacacacgggatgattacaccagacttttggcgcatgtcgagtcttcaaatcaggactgatcgggaagaaacatggtatgatggaaataaaaatgcaaggggacaacacagatggaagagcgctattcgcggcagacaagatttaagccgataggggaaaaagggcagcaggcgctggctgacagcagtgtcctgattgtcggagccggagccctcggaacagccgcggcagagggcctggcaagagccggagcgggccgtatggcgattattgaccgggattatgtggaatggagcaatttacaaagacagcagctgtatacagaagaagacgcgagacagcgcctgccgaaagcaatggcggccaaggcgcgtcttttagaggtaaacagtgatatacatatcgatgcttacgcggcggaaggtacggcggaaacacttgaaccgctgatcgaacaagcggattgcatcgtggatgcgacagataattttgaaacgagaatggtcatcaatgatctggcgcagaaaacgaaaacaccttggatttacggtgcctgtgtcagcagtcagggaatgtgcatgacgattattccgggggttacgccgtgtttatcctgcctgtttgagcaaatgcccgtaggcggagcgacatgtgatacagcaggcatcatacctccggcggttcatatcgtctccgcttatcagcaggcggaggcgctgaaattgctgacaggaaatcatgcggcggtaaatcggcgctttttcacgtttgacgtgtggaataacaccaatatgagcataaatgtggatcagatcaaacgggatcattgcccttcctgcggcgcggagcccgtatatccgtatctgcagcctgaaaacaggccgaaagcaagcgtgctgtgcggaagagacaccgttcaaatcagatcggaagccttaaagaggctggataaagaagagcttgtcaaacgtctgaagcagatcggtaaagtggaagcaaatgaatttttgctgcacatggcgtacgagcgcttcagaatcgttatttttcaggacggacgggctctgattcacggtacaaacgatataaaagaagcgaattcagttctggccagagtgatcggactgtaggaaggggatgtattgctatgcttgaaaaaagaacgccgattcaggtggacgaagcagtccgccgggtgagccggtataaaaaacagggggataccgaatgggtggcgcttgaggacagtctccaccgctatttggcggaggatgttaaggcggatcatgatgtgccggcctttaaccgttccccgtatgacgggtttgccatcagggcgagcgattcaaaaacggcttcccgtgacaatgccgtcacctttgaagtcattgaccatatcggagcaggcgccgtgtcagaaaaagaactcgggccttatgaagcggtccgcattatgacgggggcgcagattcccagaggcgccgatgccgtagtgatgcttgagctgacaaaaatgttttctgaaaacggcacgaattacatgtcagtgaaacgcccttttcatgcgggcgataatatttcatatcaaggagaagatgcgaaaaaaggcagctcgctattaaaaaaagggacgaaaatcacgccgggcgtaaccgctcttttagcaaccttcggctatgcttccgttcccgtggtcagaaagccggttgtcggcattatcgcaacgggaaccgagcttcttcatgtcagcgatccgcttgagccggggaaaatccgcaacagcaacgctgccatggtgtatgcccaggtcattgaagcgggtgcggtaccgctgaacttagggaaaatttccgatgattttgatgacagctatgctgcggtgaaggaagctatgaaaaaagttgattttctgatcacgaccggcggcgtgtcagtcggcgattttgattttcttccggacatttataataagctcggagcggaagttctttttaacaaagtggcaatgcgcccggggagcgtgacaactgtcgcccgggccgatgacatgctgctgttcggcctttcaggcaatccgtccgcatgttatgtcggattcaccctgtttgtcaaaccgatgattcagacgtggcttctgaatgaaaaacctcattccggatgggcggaagccgtgttaacaaacgactttccgaagccgaatccgtttacgagatttgtgagggcgtttgtttatcataaggacggaaaaatgatggcgtcaccggtcggtctcgacaaatcaagctcagtcacatctcttgccgaagcaaacgcgtttatccttctgccgggaggaacgaggggatatgaagcgggccggacggttcacgcgctcctcatccgtgatgagaatggaagtgaatggccgtggtcaattctttcccgatcgtccagatcgtaggttttcaaaacagcggtaaaacaacgtttattgaacgtgtgctgaaagcggcgccgaaagagtgcgatattggatgtttaaaacatcacggacatggcggagaaccggaacctttttctgacggaaaagactcggagcgtttttcaaaagccggagccgcggttacggcagtagaaggggacggcgtcctgcagcttacggcgcgaaaaaaatgggatctggcgggtttgatcagtctgtatgaatgtctgggaattgacggtcttctcatagaggggtttaaacatgcgccgcatccgaaaatcattatgatcaaaaacagcgaagattggcaaaagctgaagcatttggagcgcgtgatcgcggttgtcagcagaaatacggagcatatgccgacagatgcaggcaagcccgtattccatgcggacgatccggctgccattatgtttgtgctttcgcagctgaaaggggaatctgcttaaatggaacgttttcaaattacaagggaacctatcattgcggaaaatatcgtaaaaaaagttgaaaagcgtgaagccggcgccatcacaacgtttatcggcacggtcagagagtggactgcaggacggcggacggtgcgtctcgaatatgaagcgtatgaaccgatggctgttcaaatgctttctcaaatcggcagtgaaatcagcgcgaaatgggaaggagccgaagctgcaatcactcaccgtgtcggcgtccttgatatcggtgaagcagcggtcgtaatcgccgtgtcttctccgcacagaaaggcggcatatgaggcgaatgaatatgcaattgaacggataaaacagattgtgccgatatggaaaaaggaaatctgggaagacggggaagaatggataggcgatcagctggaaacaacgccctatccgaacggaaaaccggatttggataaaggggaatcgcgatgattaaagtattattatttgccgggcttgcggagcaggcgggaacaccggtcattgaacttgacgaaaaagagacggcggcgtctgctgtaaaaacgctgttaaaggaacggtacggccttcagacgattgacaatgccatgatcgcaatcaatgaaacatatgtaaaagacaacagcaccgtaacagaaggtgataccattgcctttatccctcctgtaagcggagggtgaaaaaagagccggatgtgcatcattgccatccggcttttttgtttataggcgctgaatttcagagaatatttaaatgggatttaaagggtttttcaattgaggcggttttcactgcatgaataggctgataacagtgcctttacaaggttttgagccacccgtcataccggtctgacgatgcttttttttacataattatggaacgtaaagctgagaatttgtgttacaatttagcataaatacgcaaacggcaaaaaaattgaaacttctctcagcctaaagcgtacgtataaacagaataatacataggaggcatcagccatatggaaccaaacctggaaaaaagcaatacggcagtcacggaaaagccgtcaattttcggcgtcattacaagtcctgttgtgcagtttaaaagattaaaagaaaagccggtcatcggcattcctctcctgattgtcatcattctcatcgcggccggcagtattttgcgcggactggggatgaattatgaagaactgctgaacagctcatctcttgacggattgaccgatgatcagattgaaatgaccaaaaccattgcgaaattcggctcgattttcggagggattttcggaggcattatcggtctctttatcgttccgcttatttattggctgtgcgtcaaaatttcaggcggcgtgacaacttataaaaaaatgctctcactcggcctctttactgcatttattactaacatcggcttagtcattaacggacttgtcatttattttaccggtgcgggctcactgtaccctgtcacatctttggcgagtgtcataccggccggagacggcgtatcggtctttttaagcgcgatcgatattttcagcatctggagctatattctgctcgctttgggacttcgctatacaggcggtatttcgaaaaaagcggcctggacttccgcgattgtcctgtttgttattatgcttttggtttcggcagtcggaggactgttaagttcagtgacagcaggtgtataacatgaaaaaaatttggatcggaatcggcatcgccgtaattgttgcagtattcatcggtatcaatatttataagtctgccgctcccgcgggcggcagcgccggaaaaaaaatcgaaaccggaaccatggaaaacagagaaatctcatctacggttatggttccgggaacacttaaattctctaaagaacagtatgttttttatgaagcagataaaggaactcttgataaagtgaaagtaaaagaaggcgacaaagtaaaaaaagggtcgtcgttagtcacttatacaaatgagcagctcaaccttgataaagaacaaaatgagttgacagaacaatcaaaacggatgcaaatcgaacaagttgaagaaaaactcagagcattaaacagcaaggaacaagatctggcaaaacaagtgggagaagcggaagccaaaaaacaaattgaatccgaacggactgatctgcagcttcagcaaaaaacggcggaaatcgaattaaagcaatctgatttgcaaaagcagtctcttgaaaatcaagtgtcgaatctcaatgttaagagtgagatggacgggacggttatctcggtaaatcaagaagcggcttctaaaaaatcggatattcaagaaccggttatacatataggagacccggaacacctggtcgttgccggcaatttgtccgaatacgacacgctgaaagtgaaaaagggccaaagcgttacaatcacctcagacgccatccccggcaaaacgtggaaagggagagtggcggctgtcggcctcgttccggatcaaaagtcaagcgctgcttcgggggaaagcacggaacaagccgtccagtatccgtttcaggttaagctgatcggaaaccttccggaaggcaagccgggatttaaattaattatgaacattgaaaccgacaaacggaaagctgacacgctgccgtcctccgcagtcaaaaaagacggagatgagcactgggtctttacggtaaaagacgggaaggccaaacgcgtgaaagttaaagtcggcgataccgcaaatcagcttacggagataaaagaggggctttcaaaggatgataaagtcattctgaatccggctgacggtttgactgacggaacggatgtgaaagcatagatgattcagctttcaaaggtgaaaaaaagctatcagatcggcaaggagacgtttgatgttctccgttcaatcgacctgacgattgaagaaggagaatatgcgtcaattatgggaccgtcgggatcgggaaaatctacgattatgaatatcatcggctgtctggacagaccgacgtccggcagttacaggcttgcgggcgaagatgtttcttcatgcaccgaaaaagagcttgcggcggtccggaacaaatcaatcggatttgtctttcagcagtttcagctgctgccgcgattgaatgcaagaaaaaatgtcgaactccccatgatctatgccggtatcggcaaaaaagagcgtgaggaacgggctgagcacgcgctggaaaaagtcggtttggcggatcggatgcgtcacatgccgaatgagctgtccggcggccagaagcagcgtgtcgcgattgcaagagctatcgtgaacgaaccgaagctcattttagctgatgaaccgaccggcgcgctggatacgaaaacaagcatttccattatggagcagttcacagagcttaatgcagagggcgtgaccgtggtgcttgtcactcatgagcctgaagtggcggactgtacaaacagagtgattttcgtccgtgacggcatgatcgtttcccgcgattctgagcagaggagagtgggggaatgagcctgtcagaaaatctccggatggccctcagttccgtaagagctcacaagctgagatcgattctgacaatgctcggaatcattatcggcgtcggttcagtaatcgttgttgtggctgtcggccagggcggagagcaaatgctgaagcaatccatcagcgggccgggcaatacgattgaattgttttacctgccgagtgatgaagaattaacagccaatccgaacgccttacagcaagcgagttttacagaagaagatattaatggattaaaaggagtggacggcgtaaagcaggttgtcgcttccgcggtaaaatccatgacggcccgttaccatgaagaagacacggatattacgctgaacggcattaacagcggctacttggacgtaaaaaagctggacgttcaagatggacggacatttacggacaatgattttctttccgggaaaagagcgggaatcatctcgaaaaaaatggctgaaaagctgttcgggaaaacgtctccgctcggaaaaatcgtctgggccggcggacagcccgtagaagtaatcggcgtactgaaagaagagagcggctttttatcgttaggactcagtgaaatgtatgtgccgttcaacatgctgaaaacgtctttcggtactaacgactacagcaacgtttccgttcagacggagtccgctgatcagatcaaaacaacaggaaaagaagcggcccgtctcttaaatgacaatcacggtacaaaagaggcctatcaagtcatgaatatggaagaaatcgcggcgggaatcggtcaggtcacgaccgttatgacgacgatcatcggttcgatcgccggtatttctctcgttgtcggcgggatcggggtcatgaatattatgctcgtatcagtgacggaacggacaagagaaatcggcatccgcaaatcgctcggtgccacgagaggacagattctgacacaattcttaattgaatctgttgtgcttacattaatcggcggcttaatcggaatcggtctcggctacgggggagcaacactcgtttcccttatcgcaggctggccgtcgctcgtttcctggcaggtggtttgtatcggcgtgctgttcagtatgctgatcggtgtcattttcggcatgctgcccgccaacaaagcatcacgcttagatccgattgaagcgttacggtatgaataaccggcgccccatgcagtctgcatggggttttttgtgttttaatgattgaatgaatataatagacttttttcatttatgataaaaagaaaatgtcatacaattgtccccctttttgtcgaatttacagtttacaaaccctatgtacatacgttaatatgaacaaatgtgaaagattttgatagttattgaatgaatttgagtgattttagttgcttgaagtaaaaaaagcgtttacaattatcttgcagccgaaatgaatacgttttcaaaggaggcggaatatgctcactcctgaaaggtatcagctgattatggatcagattgaaaagcgagatgtggtgaagattcaagagctgataagcatgacaaatgcttctgaatcaacgatcagaagagatttatcaacacttgaagagcgcgggtttttaaagcgcgttcacggcggggcgtctaaactttccaacagcaggcaagaacccgatatgcttgaaaaatcctccaaaaaccttcaggataaactgaagatcgctgaagaagcggcatctttattagaagaaggtgactgtatttaccttgatgcgggaacaactacattgcacatgattgattttatagatcatacaaaggacattgtggttgtcacaaacggggttatgcatatcgacgctttaataaggaaagggattcctttttatcttctcggaggatatgtgaagcatagaacaggtgcgatgatcggcggcgcctcattaacggcggtcagccagtaccgttttgacaaaagctttctcggggtgaacggcgtgcacattgaagccggctttacaacacccgatccggatgaggctcttctgaagacaaaggctgtgagacaggcgaaaaatgcgtatgttttagccgatccttctaaattcggcgagatttctttcgcagcgttcgccgccttgggcgatgcagctatcattaccactgaagctgaagaacatgcattcgataattaccaagaaaaaactgtcgtaaaggtagtgaaaccatgatttacactgtaaccctcaatccgtctgttgactatatcgttcacgttgaagattttgccgtaggcggtttaaaccgttcaagctatgacacgaagtatcccggcggaaaaggcatcaacgtttcgagattactgaaaagacaccatgtgccgtcaaaagcattggggtttgtcggcggatttaccggaaattatatcacgtcatttttgcagcaggaaggtctggaaacggctttttctgaggtggatgaagacacgcgtataaatgtaaaactgaaaacgggcgatgaaacggaaattaacggacagggcccgacgatttcagacgaagtgttcaatgcctttttagaacagttctccgctctggaagagggagacatcgtcgttttagcgggaagcatcccttcttccctgccgcataacacgtatgaaaaaattgctgaggcatgcagaaagcagaatgcccgggtagtggtggacatctccggtgaagcgctgatgaaagcgacagaaatgaaaccgtttttgatgaagccgaatcatcatgagcttggggaaatgttcaatacggtcattgattcagccgaagctgccgttccttacggtaaaaaattaattgaacaaggcgctgaacacgcgattgtttcgatggctggcgacggtgcgcttttatttacgaaagaggcggttttcctcgccaatgttcctaaaggaaagcttgtcaattcggtaggcgcgggtgattccgtcgtcgcgggattccttgcgggaatttcaaaacagctgcctttggaagatgcgttccgtttaggagttgcttccggaagcgcgacggcattttctgaagaactcggaactgaagagtttgtacagcagcttcttcctgaagttaaagtcacacgtctatagaggaggaaagaaaagtgaagataactgagctgttaacaagagatacaattcatctcaatatagaaagcaaagagaaagaaaacgttatcgatgaaatggtgacagtgcttgacaaagccggcagattaaatgacagagaggcttacaaagcagccattttaaatcgtgaaagccaaagctcgacgggaatcggcgaaggtattgccattcctcacgcgaagacggcgagcgtcattaacccggccatcgcattcggccgttctaaagatggtgtggattatgaatcattagacggtcagccggcacacttggtctttatgattgcggcaaccgaaggagcgaacaatacgcatcttgaagcattatcaagactttcaacgcttcttatgcgtgaggaaatccgcaaacagcttcttgaagctgaatcagaagatgcgatcattgacatcatcaatcagcatgacaaagatgacgatgaggaagaagaagagcaggaagaacaggcagcgccgtcaggaaaagggaaaatccttgcggttacggcatgcccgacaggtatcgctcatacgttcatggcagctgacgcactgaaagaaaaagcgaaagagctcggcgttgacattaaagtcgagacaaacggctcaagcggtattaaacataagctgacggctcaagaaattgaagacgcgcctgcgattatcgtggcggctgataaacaggttgaaatggagcgctttaaaggcaaacatgttcttcaagtgcctgtgacggccggtatcagacgtccacaggaactgattgaaaaagcagttaaccaagatgcgccgatttacgagggcagcggcggaggatcttccgcttcaaatgaagacggcccgaaacagaaatcaggcacaagcatcggaagtactttctataaacacttaatgagcggtgtcagcaacatgctgccatttgtcgtcggcggcggaattctcgttgcgatttcattcttctggggaattcattcagctgatccgaaagacccgacatacaacacgtttgctgcagcgctgaactttatcggcggcgataatgcgctaaaactgattgttgcagttcttgccggattcatcgcaatgagtattgcggaccgtccgggatttgcgccgggtatggtcggcggatttatggctacgcaggcgaatgccggattcttgggcggactgattgccggattcttagccggttatgtcgtagtccttttgaaaaagctgtttgtctttatccctcagactcttgatggattaaaacctgtattgatttatccgctgctcggtatttttatcaccggtgtcctgatgcagtttgtcattaacacacctgtagcagcgtttatgaatttcttaacaaattggcttgaaagccttggaactggaaaccttgtcttaatggggattattttaggcggtatgatggctatcgacatgggcggcccgctcaataaagcggcgttcactttcggtatcgcgatgatcgatgccggaaactatgcgccgcatgcggccatcatggcgggcggaatggctccgccgcttggaatcgcactggcgacaacattctttaaacacaaattctctaaacgtgaccgtgaagccggtattacgtgctacttcatgggagcagctttcgttacagaaggcgccatcccgtttgcagcggctgatccgcttcgcgtcatccctgcagccgttgtcggttctgcggtagcgggcggactgacagagtttttccgggtaacgcttcctgcaccgcacggaggaatattcgttgcattcattacgaaccatccgctgctttacttaatgagcatcgtgatcggagcgattgtaacggcggttatcttgggaatcatcaaaaaaccggtagtagagaaataagcgaaaagcgtcctttacgggcgcttttttcaatcatatgcgcatagaagcgttatgtattttgtgatgagttgtgataaagtaaagatggtacatgaaccgaaacagtgatcgtctaggaggaaccacgttgactgaagaacaaaaacctacttctgaaaaatcggtaaaaagaaaatccaacacgtattgggaatggggaaaggccatcattatagcggttgcacttgcgctgttaatccgccatttcctgtttgaaccgtacttagtggaaggatcatcaatgtacccgacattacatgacggtgaaagactgtttgtcaacaaaagcgtcaattatatcggagaaatcgagcggggggacatcgtcattattaacggcgatacgtcgaaagtccattatgtaaagcggctcatcggaaaacctggagaaacggtggaaatgaaaaatgacacgctttatataaacggcaaaaaaatcgcagaaccgtacctcgcgagcaataaaaaagaagcgaaaaaactgggagtcaacctgacgggagatttcggccccgtaaaggttccgaaaggcaaatacttcgtcatgggcgacaatcggctgaattcaatggacagccggaatggcctcggcttaatagccgaaaaccggatcgtcggcacctcgaagtttgtgttcttcccgtttcatgatatgcgtcagacaaaataaaaacgccgcgctgcccgattcggacagcaggcgttttttatttggcaaacgaggccgcgacggcgatgaacaataccgtggccagcactgatccgacaatggccagaacgctgaaaaaaagattcacctgcttcttctctttgccgcgtttttcaagcatccgttttgaaaagagatgcgaaaacgtataaatgagggcgattccgacatacaagccgatgtcacgtgccgtaaagcctgtgacggccagaaaaaccccggtgaagaaaatcataagacagtattctgtgagtgttaaaagcttcaacttgttcctccgtgatgaatatgtatatatatctattgtatcacagcgctccgggtttgacgcctgcatcttttcaaacccgtatattcgcagggaaacatttctcttcccctttattcatggtatacttttaatgatgatagacacgatggaggattctaaatgattgctgtaaataatgtgagcttgcgttttgcggatcgcaagttatttgaagatgttaatattaaatttacgccgggcaactgctacggattaataggcgcaaacggtgccggaaaatcaacatttttgaaaattttatccggtgagctggagccgcagaccggcgatgtccatatgagtccgggcgaacgtcttgccattctgaagcagaaccactttgaatatgaagactgtgaagtgctgaaagtcgtcattatgggacataaacgtttatacgaagtcatgcaggaaaaagacgcgatttatatgaagcctgatttttcagatgaagacggcatccgcgccgctgaacttgaaggagagtttgcggaattaaacggatgggaagctgaaagtgaagccgctattttgttaaaggggctgggcatctctgaagacctgcatacgaagaaaatggccgacttaggcggttcagaaaaggtgaaagtgcttttggcacaggcgctgttcggcaagccggacgttctgctgcttgatgaaccgaccaaccacttggatctgaaagcgattcagtggctggaagagtttttaatcaactttgagaacacagtcatcgtcgtatcccatgaccgtcactttttaaataaagtgtgcacgcacatcgccgatcttgattttaataaaattcaagtgtacgtcggcaactatgatttctggtatgaatcaagccagcttgctttaaagctttctcaggaagccaacaagaaaaaagaagagcagattaaacagcttcaggagttcgtggccagattcagcgccaacgcctctaaatcaaagcaggcgacatcaagaaagaaactccttgataaaatcacgcttgatgatatcaaaccgtcatcacgccgttatccttatgtcaatttcacgccggaacgcgagatcggaaatgacgtgctgcgggttgaaggcttaacaaaaacgattgacggggttaaggtgcttgataacgtcagctttattatgaacagagaagacaaaattgcatttacgggccgcaacgaacttgccgttacgacattgtttaaaatcatttccggggaaatggaagcagacagcggcacatttaaatggggcgtgaccacttctcaggcgtacttccctaaagacaacagcgaatattttgacggcagcgatgcgaaccttgtcgactggctccgccaatactcgccgcatgaccaaagcgaaagctttctgcgcggtttcttaggacgcatgctgttctcaggagaagaagtcaacaaaaaatcaaacgtcctttccggaggagaaaaagtgcgctgcatgctttcaaaagcgatgctttccggcgcgaatatcttaattctggatgaaccgacaaaccacttagatttggaatccattacggcgcttaacaacggcttaatcagctttaaaggcgctatgctgttttcatctcatgaccatcagtttgtacagacaattgccaaccgcatcattgaattaacgcctaaaggcattgttgacaaacaaatgtcttatgacgaatttcttgaaaacgcggatgtgcagaaaaagcttgaagagctatacgcgtaataaagaagcaggggagactctgcttttttatttatgaaaaaagttttcaatcttctgacttcccgttacaataaaggaatacataaattgaaaagagacggaggaatgcatcatgaagtttttagttgtcggagctgggggagtgggcggatatattggcgcacgtcttgcagaaaagggaaatgacgttacgtttctcgtccgtcagaagcgggcggaacaattaaaagagacgggattgaccgtcaaaagtgcaaatggtgatgtttcaatcaagccgaaaataatcatggcgggcgaagatggagagtttgacgccgttatcatcgcatcaaaagcgtattctttgcaggacgtcattggggatgtcaaaccgtttgtcaaaccttcgtcggtcattattccttttttaaacggatacaggcactataaccagctgtttgaagctttttcaaaacggcaggtgctgggcggcctctgctttattgagagcgcccttaacgacaaaggggacattcttcatacgagcgctgcccaccgctttgttttcggtgaatggaacggggaacgcacggaacgtataaatgagctggaaaacgcatttgcaggtgtgaaagcggatgtcatcatcagccgggagattgaaaaggacatttggaaaaaatatatgtttattgccgcgcaggcgggcgtgaccactctgtttcaacagccggtcggaccgattttagaaacagcaggcggccgcagcacggcaaagcgcctctttgccgaaatcggagccattttcaaggctgccggcatcccgaaagatcctggtctggaagaagagagttatcgcacattgacaagcatgtcttaccatatgaaatcgtcgatgctgagagatatggaaaagggcagggtgacggaaggtgatcatttacacggctttttgcttgagaaagcgaaaggcttgtcaattgatacacctgttttggaaaccgtctgcgccaacttgcaaatgtatgaagcgaaataaaaaggaggcctgatcgcctcctttttttattaaaatgcccagtttccgtttctgaagatcggttctcttttcccgtccgcggtaataccgtcgatattcatgtctttggaaccgaccataaaatctacgtgtgtaatgctttcatttaagccctctttaacaagctcttcccgtgtcatttgtttgccgccctcaatattaaaggcatacgcactgccgatcgccaagtggttagaggcgttttcatcgtacagtgtgttgtaaaataaaatatttgattgtgaaatcggtgaatcgtaaggcactaaggccacttcaccgagatagtgtgagccttcatcggtttcgacgatgccttttaaaatctcctcgcctttttcagctttcacatcgacaatgcggccgttttcaaaggtaagagtgaagttatcaataatgttgccgccgtagctcagcggtttcgtgctggaaaccgtgccgttcaccccgtcacgctgcggaagggtgaaaacctcttctgtcggcatgttggccatgaattcgtgaccgctttcattcacgcttcccgcgcctgcccatacatgttttttcggcagttcaatggttaagtctgttccttcagcctgataatgcagggcgctgtaatgttttttgttcaggtgttccactttttcatgaagattttgatcatgttttttccatgcttccacagggttttcttcatttacgcgggtcgttttgaaaatttcttcccataaaagctgaacggctgtttcttccggctgatccgggaacacttttttcgcccagcctgttgaagcagctccgatcaccgtccagctgaccttatctgattgaatatattgtctgtatgtatgcaatgcttttccggcggctttttggaacgctgcaatccgtttgccgtcagtgccttttaacaggtcggggtcggatgagacgacagaaataaacgcagccccttttttcgcgagctcttcttttccttttgcttcccattcaggatactcttcaaacgcttcaaaaggtgccatctcgtattttaatctggacagttcatcgtcctgccaatttacggtgacgttttttgcgcctttttcataagaatgtttggcaagcagtctgacaagttcccggacatcagttgaggcattgattacgacatgctgtcctctttggacattgacgccgacttctaccgccagctgagcatatgtatttaacttttcagtaaacgaactcatcgttcattcctcctcatcggtttttctcatcatatcaaataacgcctcataaaggaaagaaaggagcacaaacgaaaaagacacagcttttgctgcgtctttacgggtgattcagttttacggcgccgccggccggagaatggggcatattggccagtgaaatgctcataccccccaaaataattccgcttaaaatgacggctactgctacgcgtcttcccacatctctaagcatatgcttcctccttaatgtttctccagttctcacaatatgagccggccggagaaaaaagaagcacaatcttattatttaatcgctttttgcagcttgtcgatgacgtctaatgaacgcccagtgccgatagccactgattcaagcggatttgccgccaaatgaacgggaacgacgatttcatctgtcagccattctttcatcccgtttaaaagggagcctccgccggttaacacgacgccgcggtcaacgatatcaccgctgagctccggcggacaatcttcaagcgtcgctctgatcgcttcaagaatatgcaggagcgactcacgcatcgcgtgctgaatttcattagactgcagtctgattgtcttcggcagaccggttacaaggtcacgcccgcggatttccatcgtttccggcacatgttcgatcaatgcaaatccgatttccattttcacttgttctgccgtacgttccccgatcagcaggttgtatttttttctgacgaacgaggcgatatcttcatcaagctggtcgccgccgattctgatcgaatggcaggatacgacgccaccgaatgagatgatggcgacttcagtcgtaccgccgccgatatctacgacgacgtttgcgaccggctcgtcaacagggaggtcggccccgattgcagcggctacgggttcttcaatcaagtgaacgtttttcgctccgcagtttttgacagcgtcactgatggcgcggcgttcaacggctgttgagcctgaaggcgtgcagacgacgacattcggtttgcggaaggtcattccgattttttttccggcttttttcataatgtgttttaataagtcagttgtcatatcataatcagcaatgacaccgtctttcatcggccgtacggcgacgattttccccggcgtctttccgatcatgcttttggcatccgttccgatggcaagcaccgctttcgttgttgtatctacagcgacaacggaaggctcgtttaaaataatacctttatttttactgtaaacaagtatattagcggttcctaagtcgattccgatctcagttgattgaaacatgttttcacccaatccctatcctgatttaattgattctacatttaaagtttctgagaaaaaccacgatttttggggtttccgccgggaatgaaatgtttttgtaaaaaaggagggaaagtctgtatcccgtatttcaaaaggctttttttctgtaaaaaacattcatttccggatgctgagaaacttttgctccgttcctttcgtctacgtttatgaaggattttccttggacataaagaagagacattaaaggaagtaggggatttctatgaaatcaattggtgtagtaagaaaagtagacgaactcgggcgtattgtcatgccgattgaattgagaagagcattggatatcgctattaaagatagtattgaatttttcgttgacggagacaaaattgtcttaaaaaaatacaagccgcacggcatttgcttaatgaccggggaaattacctccgaaaatcaggagtacggcaacggcaaaattattttaagtcctgaaggagcgaaaatgctgcttgaggaaatcgaggaagcgttaaaagatagatcataatcagcaaaaagggcggggcatcattccgtccttttattatgaacttgtgcaaaaactcacgggaaaagtaagcgaacctgctcaattaattgggaatagttatcattttttagtcaataatgcagtcaacaatgttacaatatatgtagaaatgctagcggcaggtgggactatgggaaaatatcaagcgcgtatcatttccttaatcttggcaatgatttttattatgttttgggattatttattttatatgattgaacggaatccgattaactggcccgttgacatcacctttaccgccgtcacattaatcagcgtctggctgctggcttattatgtggacaataaaaagcagctgctggcggagctgaaggacagcgagcagaaagcaaaggcgctttcagatgagaaaaaccggatcatggacaatttgcaggaaatcgtttttcagacggattcacaagggaatattacatatttgaatcaggcctggacgacgattacgggccactccatcagcgaatgtatgggcacgatgtataatgattattttataaaagaaaaacatatcattgattatattatctcccaaatcaagcagcagtccccgtcaggaatgtttacggccaaatatattaaaagagacggcacgattttttgggggaagtccattataagctgtattatgaccgcagacagaaatttgtcgggagcctggggacgatgtctgatatcagtgaacggaaaaaagcggtcgacgagcttctggaaacgaacgaacgccttgccatgcaatctcaaaagctggccattgccggagagcttgcggcaggaatcgcccatgaagtaagaaatcctttaacgtcagtcagcggctttctccagctgatgaaagcccagtatccggaaagaacggattatttcgatattattttttcggagattaaaaggattgatctcgtgctgggggagctgcttctgctcgccaagccgcagaccgtgacgtttaccgctcatcatctcaaccatattttaaggcaggtggcgacgcttcttgacacgaacgcggtgctgtcgaacactgtgattgagaaggatttcaggcagactgagtcctgtatggtcaacggtgacgaaaaccagctgaaacaggtatttatcaatattattaaaaatgcgattgaagcgatgcctgacggcgggaatattcatatttatacagaacgggatgaagaatacgcggtgatcagcatacaggatgaaggaaacggcatgtcgaaagaaaagcttgaaaacatcggcaaaccgtttttctcaacaaaagatcagggaacgggtctcgggcttccgatttgtttacgaattctgaaggagcataatggtaaacttaacattaagagcaaaaatggagaaggcagtacgtttcaggtgattctgccgttagaagcggctgctgtccaaaaggaggaaaaataacttgcttctttttgtatacggtttgttacggaagcgtgaagaaaaccatgaactgctgaaaagcgctccgtgtgtgtgcgagcaggccgcgataaacggtgtgctgtacgaaacggataaaggtcagcctgcggcgtctttagcagaaacagcttttgtgtacggggaattgtatgaaacagatcatcagatgatccgtaagctggatatgtattatgctgattttgaccggaaagaggttgccgtgacgacggatgccgggaataaaaccgccttcgcatatgtcgtaaagcccggccagtgtgcctcattcagccgtatcaaaagcggagactggaaagaataccgttttatgaaacgggaggatgacagtccggtttattatttcgcttacggctcctgtatggacaatgcccggtttaaacaggcgggggtcgaccacttctttgccgagccggtcggaggggcggttgttgaagggtattcgacgagattcacgttaaggcgtcctgacggttccagagccgatcttgttgaagacgggggacgaactgaaggcgtgctgtacaagctcccgtttgaagcggcaacctatctgtacaaaagagaaggtgttgataatcacacataccgtcccgcgttcatagaagtgtgtgccggcggccgtgtatacagaggcgtcctgacgtttctggttcttgataaagctgaggaaattgcgcctccgggtcactatcaggaagaaatcgaacgcggagcggacctgtatttatcacccgccttttcagagaagcttaaacgctatatgaactcattgccgaaaatgtgatactattcctattagagatattgtttaaaggagtactgttatgagaaaagagtttgccgttatcggtctcggacgcttcggcggaagtatttgcaaagcattaagtgaagaaggccttgaggtcatggcgatggatattgatgaagataaagtaaatgaatacgccaaaatcgcatcacacgcggtcatcggcgattcaaccgatgaatcggtgctgaaaaacttggggctgcgcaactttgaccacgtcattgtggcaatcggcgaaaatatacaggcgagcattttaacgacgctgatcttaaaggaactcggcgtgaacacgatcacggttaaagcgcagaacgattatcatgagaaagtgcttgcgaaaatcggggccgatcacatcgtccaccctgaacgtgacatggcaaaacgcatcgcccacaacatcgtatcaaataatgtgcttgattatttggagctgtccgacgaacacagcattgtggagatcgtggccaacagcaggcttgcgggcaacacactgcttgatctggacatccgggcgaagtacggcattaatatcgtggccatcaagagagaaaaagaagtgatcgtatctccgctggcgactgaaatgattcaaaaagaagatattctcatcgttatcggctctcttacggacatttcccgatttgaaaaaagagtgcttcatacaaagtgaaaagccgtccgtaaaaggacggtcttttattatgtcagaatagaaagacatttattgtgtaagcggtatattctgcaatttttattgactatgatcaggcgatccgatagcatattgtaccatataaagaaaaagaggaggcctcattttgaacaaagaaacactggctgaacggctgaatgcatcagccggcagacaaaaagccgataccgtcattaaaaacggaaaaatcatggatgtatttaaccaggaatggatttctgcagatatcgccattacgggcggagtgatcgtcgggctgggcgaatatgaaggggaagaagtcattgatgcagaaggtcaaatgatcgttccgggctttattgacggacatgttcatatcgagtcctctatggttactccgattgaatttgctaaagccgtcctccctcacggagtgacgactgtcattactgatcctcacgaaattgcgaatgtttccggagcaaaaggcatttcatttatgatagagcaggcgaaaaaggcgccgctgaacatccgtttcatgcttccttcctgtgttcccgccgctagctttgaacgctcaggagctgtattaaaagccgaggatttaaagcctttttatcaggagaaagaggtgctcgggcttgcggaagtaatggattatgtgtctgttgcggaaggtgaagaggatatgcttcagaaactgcttgatgccaagcgtcacggaaaacggatcgacgggcatttagccggactgtcttcagatatcatcaatatatacagaaccgcaatggtgtcaaatgatcatgaagtgacgacaaaagaagaagcgctggacagaatcagacggggaatgtacgtcatgctgcgcgaaggatcggtggccaaaaatacgctcaatgtgctgccggcggtgaatgaaaaaaacgcgcgccgctttttcttttgtacggatgataagcatgtagatgatctgctttcagaaggaagtgtgaaccaccaagtcaaaatggcgataaaggcgggacttgatccattccttgcgtatcagctcgccagcttaaatgcggctgagtgctacggccttgaaacaaaaggggcggtagcgccgggttttgacgcagatctgctgttcatttcagatgtacgggaggctgccgtcacgaagaccatggtcgccggccgtaccgttgccgagaacggacgaacagttgatgaacagtctgccggttcctattcgccggaccaggcactgttggatacagtgcggctgaaatcgccgctgactgaatctgattttcatataccgattcaagagggcaggaaaatgaaagtaatcgaaatgataccgaatcatttggagacgagaaaaaaagaagtgcctgcaccgtctgctgacgcgtttcgttctgatacagataatgatttattaaaaatcgccgtcgcagagcggcacagcggcgaaaaaatgataggactcgggattgtacaagggttcgggttaaaagaaggcgccatcgccacaaccatttctcacgattcccataatatcatcgccgtcggtacaaacgatgccgatttggcaaaagcaatcaacaggctccgtgacaccgggggcggattaacagccgtgaaaaacggagaattgcttcactccgttccgcttccgatcgccgggcttttgtctgataagtcggcggaatgggtcaatgacagcttgggcgtgcttcatgaaaagcttcctctgctcggattcaccggtgatttcaatccgtttctcaccttatcgtttttagcccttccggtgattccggatattaaaatgacggcggccggtctgtttgatgtcaaagcctttcagcatattccgctgcaataaaaaaactgcactcgtaatgagtgcagtttttttagacctccataatgatcggaaggatcatcgggcggcgttttgttttttcgtataggaacggagcaagcgtatcggtaatttcgtttttaatttcggaccactgcgttgttttccgatccattactttctccagatggttcgaaatgagctgctgcgcgtcattgatcaaatcaccggattctctcatgtatacaaaacctcttgagattaaatcaggtcccgccgaaaccttaaagtcgtccatattgatgctgacaacaacgataacaaggccttcttctgaaagaatgcggcggtcgcggagcacgatattgccgatatcaccgattccgcttccgtcaatgtaaacggagccggacggaattttgcctgccacagcggcttcttcgcctttgagggccagcacttcgccattatccatgataaagcagttttcttcaggtatgccgcaatcagtcgcgagtttgacgtgcattttctgcattctgtactcaccgtgaatcggcataaagaacttcggtttgatcaggcggagcattaatttctgctcttcctgtccgccgtgtccggatgtatgaatgtcattcaatgaaccgtgaatgacttctgcgcccgcacggtacagctggttgatggtgcggcttacgctgattgtgtttccgggtatcggagaggaagaaaagacgactgtatctccgggattaatggaaatctgccggtgcgtcccgttagcgatgcgtgataacgccgccatcggttcaccttggctccccgtacataaaatcgttaccttattggcaggcaaacgattgatttcgttatgctcaataaacgtatttttaggacaggtaatgtaaccgagattttgtccgatttcaatagccgattccatactgcgtccgaatacggcaacttttctgccgtttaaaacggctgcttcaatcacctgctgaagacggtgtatattcgaagcgaatgtcgcaaatataattctgccgtccacttttcggaaaatatcgtgaatgctttcgcctacgcggcgttctgacatggtgaaatcaggcacctcactgtttgtactgtcagaaagcaggcacaaaacgccttctttcccgatttcagccatctttgtcaagttggccggttcgcctaccggtgtgaaatcgaacttaaagtccccggtatgtacgatattgcccggcggtgttttgacgacgattccgtatgaatccggaatgctgtgtgtcgttctgaagaaggatacagacgtcttgcggaacttcacgatgtcgtcttcaccgatgatgtttaatttggtctgtcttaacagcccgtgctcttcaagtttattccgaagtaagccgatcgcgagtttaccgccgtaaacgggaatatttacttgtctgagcaggtacggaataccgccgatatggtcttcatgaccgtgggtgataaacagacctttaattttatcttcattttttactaaatacgtgtaatcggggattacgtaatcaatgccgagaagttcatcttccgggaacttgattcccgcatcaatcagtacaatttcatcctgaaactgcaccccgtacgtatttttcccgatctcgcccaatccgccgagggcgaaaacggcagtctggtcattttttacaaatttcattccgctcataactccaatactttaaaattttcgctctgcttctcatattctaaaaaagcaccgtccacaggctgaacaaattcaatgttgtatttctgatctttcagtttcgttctgacgtcccgttctgaaacgccctcaatgtaaagtgaatctgttttttcccgaacaggtacttcgtcagccttctcttgataaaataccttataaatcatccaaatctctccttaaatgccgtatgttagactcgcttattctattatattcgaaaacggattataaggaaagtctcgagcaaaaaagggactttcaaaaaccgaaagatcccttctacgcgatgacttttttccggagcattccgccccactgtcttctgagtttcttccgtaatcggcgcagcatcgtatacctcctttaaagccctttatagcagtagtatgcggaaaaaatgaatttgttttcgtgggtaaaactggaatttgatcaaggcggttttccggaagaaaaactttctgtatgatgatattgaaaaagacacgactgataaacgggaaaaaggagaaattgacatgaaaccaaaactgatcttttttgatattgacggcacgatctatgaccatgataaacatattcccgatagcgcaagaaacgccgtgacggcacttaaagaggctggccatcacgtttttatcgccagcggaaggtccccgtttatggtaaaaccgattctggaagagcttgagattgaatcatttatttcatacaacggccagtatgtcgtatttgaaggtgaggtcatttataaaaatcctcttcctgaagatgcggttgcgcgtttattaaagcaggcggcagaaggggagcaccccgtcgtatttatggcggaagacacgatgaaaacgaccgtccccggacatccgcacgtctcggaaggaatcggcagtctgaaagcgccttatcccgaagttgatgaaacattttataaaggaaaagaaatttatcagctgcttttattctgccgcggacatgaagaaaaagcatatgccgcttttccggagtttgattacgtccgctggcatgaattgtccacggatgtgcttccgaaaggcggttcaaaagcggaaggcattaaaagagtgcttgagcggcttccgtacggcgtaagtgatacttatgcattcggcgacggactaaatgaccttgagatgatccgttttgtcggcaccggggtggcgatgggaaatgcggttccggaattaaaagctgccgccgatttcgtcacaaagccggtggatgaagagggaatcagctgggccgtcaaagaactgggccttttgaaataaagaaaaccggcactttgggaagtgccggtttttttttaacggtcaatggcaatggcgttttcaggttctttgaacggatcttctttatcgatatggtcgtaaaacatcacgccgttcagatgatcgatttcgtgctgaaacacgatggccggaaaacctttgaggcggatgtcaatctgttctccttcaagcgtcaccgccttcacgcggatgcgggcgtagcgcggcacatagccgggaatgggttcgtctaccgacaggcagccttctccgctcgtcaagtagcttttttccactgagtggctgacgattttagggttaaaaagagcatagctgtataaagtgcctttcgcatcttctgcatggacggcgatcatccgtttttttacgtctgtttgcggagcggcaagaccgacgcccggacgaaggttgtatttctcggctaattcaggattttggctgtttttcacaaactcaatcatatcagcaagatgctgtttttcttcgtcagaagcgggaagctgaacctcttcagcgatctctctgagcgcgggatgtccgtcgcgtacaatattttccatagtaatcaagaaacttcactcctaaagcttaatatgtaaattatagcgaatttctttatcgcggcgcaacgaaacaattggccggccatagcaggccggccgattttcatggtgtataaggtcagcagccgcagcctaaataagcggcaccgacgatgattaataagataaacaatacgacgattaatgcgaatgtgcggccatatccgccgccgcagccataaccgtaaccgccataaccgtatccgccgccgcagcaaccgccgccaaatccgccgccaaatccatatccgtacataaaaaaacctcctcttttaattacgctgaccctttgtcagcagggccggcgtctactataaactatgtaaaagccaaaaagatgtatggtcatccgccctgttttctcaattttttacgccagtattctttgacagcaccgtaagcgtctttttacccggtcatgccaattacagctcagctattgtcaaaaagcgttcgggcttctatagtggaaattgtcaagattgggggattttaagtgaatatgattcaaaaaaaggtattagcaggaatcggagcgctcggcgccgcaagtatgctgcttgcgggctgcgggggaaaagatccggttgaatcgcttcatgactcgatggaaaaagccgttcaagcggaaaaaccgtttcaaaaagagcagaaaacattggaaaaattggagaaaaaagagcacaagctttacgacagcgcggttaaactgaatatggatgattacaagaaaatcgtcacactgtctgatcaggctctgagcaatgcaaatcagcgaaaaaaacatctgaaagcagaaaaagacagtattgatgattcaaaaaaagcatttgaatccgcaaaaaaaacttctcaagaaataaaggataagaaagtaaaagaaaaagccgggcatgctgtcgctttaatggagaaaagatatgcatcttatgatcttttgtacaaaaagtacgaaaaagccatttcacttgataaggacctttataaactgattaaagataaaaagctcacattagcgcagctggaagagcagatcagcaaagtaaactcagtttacgaaaaggtgcataaacaagcagaggagttcaatcaatttactaaagactacaacaaagagaaagaactattattccgcgaatagtatagtgaaggcatatcggcatgggctgatgaactgataacaaccgagttcagccgcctgtaaaatggcggctgaagaattggtatatacgtgtgtttcccattgacaacatgtaaatcatggtatagtatttatttagggaaatattcacataaaaccaatcgttgtttcggcacgttggaatgtttttattatattgatatataaaaaacggaatgaaaatgtggttttaattatcagaaaattctatctatttatatttgcggcaatatgatatttgcacatgctttttgcttttaaacctttatccggcataaaggtttttttattttgcttcgtattgcttattaagtaaatgacaattttaaaattgaagtgaaaaatgttaatcaaataacaatcggaacgaaaagaaacggcagaaatacggaacaaggaggaaaacaaatgcttgcttacgtctttcccggacagggagcgcagtttaaaggaatgggcagagacttattcgatgaattcagtgagctcattaaaaaggcagatcatattttaggatactccataaaggatttatgccttacagatgaaaaagagaggctcactgatacgaagtatacacaacctgcaatttatacagtgagcgcactgcaatatttaaagggtttaaaagaaggtcatacacgccctgatgctgttgcaggacatagtctgggtgaatatactgcgctttttgcggccggcgtttttaattttgaaacaggtctccggctggttgctaaaagaggcgagttaatgagtgaggcttccgagggcggaatggctgccgtgatcggactggatgagcatcacataaaaaaaatacttcaaaagtatgaattcggccaaatagatatcgccaattacaatacatcttcacaaattgtgatagcaggggctgcagaagagataaagcgggcagcctctttttttgaaaaagaaggggcgaaagcttatatcgtattgcaagtcggcggagcttttcattctcgttttatggaaagtgcacagcgtgaatttgcggaatttatcgaggagtttcatttttctgaattgaatttcccggtcatctctaactatacggcaagaccttataaacaagaagatatcaaacggaatttaattgaacaaataacaaactcggtgaaatggactgaaagcatcaggtacttaatgggacaaggcgtcactgtgtttgaagagatcggtcccggaaacattctgactaaattaattcaaaccatacaaagagatgaggaaccgcttaatattagtgcgccggaagacagtctcttgttttctgaagggaacaaggacaattcggaaagcgggaaagagaagggcctcttggccgaaaatatagaaagcagtgcggcttcaccggtgtcccaattgggtgatcaatctttcaaagaagattacggtttgacatacgcgtatttggcaggtgcgatgcatagagggatctcttccgctgaaatgctgatccgcctcgggaagaaaggaatgctggggttctttggcacagcgggtttaactataagggaaattgaacaggctcttattactattaagaagacactcaaaagtggccagccctacggaatgaatctgcgatttgagccggatcatcaagatagagaaaaggaattgatagatttatatatcaagcatgacgtacgggtaatagaagcgtcttcgtatctttccgtcagcgcgccattaatttattacaaagcgcatcagttgaagatggacaaaagcggcagggtcatacctcataatcggatcattgccaaagtttcacggccggaagttgcggccgcatttctgagtccgcctcctcaaagtatcgtaaagagaatgtgtcagcagggtatgctgacggaagagcaggcggagtggctcagccgtgttccggcagcagacgatatcattattgaagcagattgcggcagtaataccgaacagggctcattgacggcgatgctgccgttttttgttaacctgcgggatgaaatgatggaaacacacaaatacgcaaggaagatcagagtcggggccgcgggaggaatcggaactcccgagtctgcggcgtctgcttttttaatgggcgctgattttattatgacgggatccattaatcaatgtacagttgaagccgaaacaagcggttttgttaaagaaatgctgagtgagacaggaatatgcgacactgcttatgcgccttcggagactctgtttgagttcggaacaaaggtgcaggtgctgaaaaagggcacgctgtttccggtcagggcaaataaattatttcaaatctaccaacaatatgagtctttgagtgagatagatgaaaagacaaaaattcagctcgaaaatgtttattttaacaagacttttgatgaaatctacgaaagcataatagaaaaacagccgaacctggcccaaaaagctgagcgcaatcaaaaatataagatgctgttactatttaagtggtatttgcagagaggatgtctgcttgctttggaagggcaggaagaacaaaaggtgaatttccaagttcattgcggcccgtctttaggcgcttttaatcattgggtaaagggcacggatttggaatcatggagaaacagacatgtcgatgacattggtgaaaaaatgatgaatgagaccgaaagtctgctaaggcgcagattggatacgttatttctacactaaagaaggggcgggtggaggccaatggttcatttgaataaacagagtgcggatatcgcgataatcggggttgcttgcagattccccgatgcagatcattatcatgaattctgggaaaacataaatagcggcaaagattccatccgggaagtgccgattgaacggtgggatcccgatctttattattcagctgatatcagtataccgaacaaaacaatcagcaagtggggaggttttattcataaagctgaccatttcgaccataagttttttaatatctctccccgggaagcgaaaaacatggatcctgagcaaagaatccttttagaagaaacttggcggtgcatcgaagattccggggtctctttgcgggatctccagcgtaaaaccacttctgtttttgcgggtattatgaattctgactaccggcagacaggtcatgctgaatcggaaatcgacagttacgcctgtttaggaagtttcgaagctatgctctccaaccggctttcatacacattcggtttgaccggaaaaagcatgtctgtaaatgccgcttgtgcatcgtcgcttgttgctttacatgaagcggttaagtcattgcggacaaaagaaagcgattatgcaatcgcatcgggagtaaacttgaatttccaacccggaaaatatatttctttttctaaagccagaatgctgagtcctgacggcaaatgtaaaacctttgacgcagcggcgaacgggtatgttcccggagaaggggcaggcgttgtattgctgcagcgccttggtgatgcagtaaaagccggtcaccatatatacgggatcataaaagggacagctgttaatcatggcggtaaatcccgttccataaccgctcccagagcagaagcgcagtgccgggtcatctcagaagctttacacaacgctgctgttgatgctgcgacggtttcttatgtagaagcacatggcacaggtacatctctgggcgatccgatagaaatagaagcattgacaaaagcgtatcggcaatatactgaggatactcaatattgcaggatcggaagtgtgaaaacaaatatcggtcatacagaagcagcggcgggaatggctggattgataaaagttctaatgatgatgaaacatcggagggtgccgaaaagcctgaatgtacatacggtaaatccaattatacagtttgaaaaaacaccgtttaggccggcgcttgattcaagtgattgggaggcggcagacggggctccgctcagggccggaatcagctccttcggttttggaggtgttaactctcacgtcatcatcgaagaatttatacatacaaaagacgaatctgacagaaagggaagggttcccttccttttttccgctaaaagtgaagaaagcatgaaacaaatgatacataattggagaaccttttctgacgattctgaggaattttgcaaaatatcaaatgaagtgatcagcagcacccttttaacaagggcatcgtttgattacagggctggtttattggcaggcagcaaggaggaatttaaaaatcagcttaaagagggattaagttttcggaggaaacaagattctgaatgggcgcttgccatcggtgacttcaaatgggaaagttataaacaatttgccgttttgaaacgcgtgttccctgatttagaaaagaacgtaaggtcggtgctgaagggtataccaacattgcacagttcatttaaaagaaaatggacgcctgagaaaatccgcttgtattctttagttatcaatacggaaatcataaaaagtatcctggcatccggttttaagccaagcctcattacaggcgccggagacggatattacgtcgctcttgcagcagcggatatcatcaaaattgaaaaggccatttctgtcatcacaggcgctgaaaaaccttcgcacttatcctgtgagccgtcgaccattccatttgtcaatccgtacactgcaaaaacgtacccgccggttcgattaaatgaagaatatgtaaggatgctgctgaacggtctgagcttcccggctgattttacagaccgcctgtacgggaaaacacggctgcttcttgagcaccaatatacgtttaaagggtttttagaagagtgggataaagcgggaaagactcaggaaatcgagattttatcttatattgtgaatcgcacggcggataaaagaaacgcattgccggctgatgaggaagcggcgatcatggctatccttgcctctatgagaagactgtataagagatgggatttaacagattatgatggattctttgataatgattatgttctggaaatattaaatttactggatgagggaatcttgtctaaagaactttttctgagcatgttattgaaaaagcaagacggaattaaacaggctgttgcttgtatgaatgagcagccggcaggtttttatgataagactcgttttccgctgatgacagaatacaatcaaatggatgccgtgtctcaggagatagctgaccatatgccgcttcacacggaagaaaagggaacggagccggatgtgaatatctctgatttttcagtttttcaattcggatcgctccctccatcagcaaaactaaacaaagcggctgcttttgaagcggacaaaccagccgatgaggctctttatcattcatttatgcaaatgtggctttcaggagaagagattgaatgggcgaaactaggtgattatcataaaagaaaagccccgcttccgccttatccgtttgagcgctctcaattttctttaaaccctcagccggtaaaatcagacgcggctttttcagaaaagaagaatcaggcactttatacgccggtatggaaagaaaccgaacttgagaatgaagcgggcagcggacaagcctgtactattttgttgttctccgggaataaagactattttgaagagctgaaaaaaagagagaatacgtccgcataccttattatgcccggtgagcgtttagagcagataagcgacagtgttttcaccatcaacaggcagcgtcccgaagattatcaaggtgtcattcgtctgttaaaggaaaaaggcgcagcgcctgatgcaattttgcatacttggtctgaaaaacagcctgaactggaagaaacactcgaatcaggaatttattctgtgttttatctgactaaggctttaatcagcgagaaccttataaacaaagtaacgttcatttatacattcagcgcagatcaaaaagaaaaattgccgtattttgaaggtgtgaacggttttttaaaatcgataaaacaagagtacccgcagttgcattgtaagacggtttgctttgaacatgattctgcatccgtttcattttcagagaaggctgacattctttataaagaaataaacacagcgcctgatcggcatattcatatcacttacagaggctgcgtaagatatgcacggatgttagagaagcagagagaaacaaacagaaagaccattcaataccctgaaaaagataaagtatatttaattacagggggattcggggggattggcagtaaaatcgctgaatattgcgcgaaaactgaaagatccactattatcctatcggggcgatctgttttaaacggagataagcagaaacatttagaatacctgaacagctttaaagcaaaggtttattatatacaggcgaatatatccgataaagaagcggtaaaaaaaatgattgacgatattaccgatcagcatgcaggtcttcatggcgtcattcattgtgcaggagttatcagagactcgctgctttttcgaaaaacaaagcatgaactttcagaggtgattgctccgaaagttcatggcgcattgaatcttgatcatgcaacgaagtcgctcgaattggattttttcgccgttttttcttcagtcgtctctattgcagggaacgaaggacagtgtgattatgcatatgcaaacggctttttagatcatttcgccgaatatcgggaacagaaacggcaaaagtttctgcgcagcggccgcaccctgacaatcaattggcctttatggcaagacatcggaatgggggcgaacctgtcaggtcaagggcggacgtctctttttcatggttccgggctcgaagaacttcctgctgaagacggaacgcaatggttttcgcggattgtaacttcgggtcagctgcataatattgcagtctgcggtgatcacgaacgctttgaacaatttatgcagcagagatttttgacggacgaaacagagacaggcagtgccgttcctttggctcaaggcgatattttggatcagacagttttgtttttaaccaatatcatctcctctgaggtcggtgcagaacgggaagagatcgatcaagatgtgcatctggctgaatatggaatggattcggttatgattcatcaatgcaacacaaagctggagcagtcactgggagcaatttcgaaaacgcttttatttgaatttcatacaatcagagatttagcagatcatcttgtaaaggaatacccggatcggctggggcgtttattttcacgggaggaaaaaggaaaacagattcagagcattacccccgccaggccggaacaagacatcactgcacctgcggcggaggaaaaagaacatcttgacgggatagcggtaatcggtatcagcggccgttatcccggggctgaaaatatcgaagaattgtgggatcttctatcaaaagagagaaccgcaatcacagaaattccgaaagaacgatggaattatgagacctactatgatccagaccccgctaaagcgcatgagggaaaaatttattgcaaatggggcggatttttaaagaatgctgaatcatttgattctttgtttttccaaatatcgccgagagaagcagaagcgatggatcctcaggaacgaatatttctcgaaaccgtatggaaagcatttgaagattcgggatataccattgaagggttgaggaagcagaccgaaaaacatgtcggtgtatttgcgggagttacaaccaattcttacaagctgctcggcgaaagaataccgacggacaaaaacgatgtacttccaaattcgttcccatggtctctcgcgaacagagtgtcttacacatttgattttacgggtcccagtatccctgtagatacggcttgctcttcatccttaacggcaattcacatggcttgccaaagtttaaaaaaaggtgagtgctctgttgcggttgcgggaggagtaaatttgtatcttcatccttctgactatttataccggtgtcagatgggaatgctttcaaaatcgggaaaatgcagaagttttggagaaggcggcgacggtttcgtgcccggggaaggtgtcggggccgttattcttaaaccgcttaaagatgccatacgtgataatgatactgtgtacgccgtcataaaaggaacggcaattaatcatggcggaaagacgaatggctatacggtgcctaatcctgccgcacaggcggatttaatccaaggagctcttaaagcggccggttggagcgccagaagtgtcagctttattgaagcccacggcacgggaacgccgctgggtgacccgattgaagtccgaggcctgaccaaggcgttcagagcttataccgaagatgtttcatattgctctctcggatcgattaaatctaacatcggtcatctcgaagcggccgcgggtattgccggcctgacaaagattattttacaaatgaagtataaaaaaatagccgcaacactgcatgctgaacgggtgcatccggatctttatctggaagagacacctttttgtctccagcaggaaaccgccgactggataaaacccgtgaatgaaaaacattctgacagcaaatatccgcggcgtgcgggattaagttctttcggagcgggcggggcaaatgcacacatccttgtggaagagtatgagtctgctgctgactgtcaaacggattgtgaggaaagtgaggaacttatcgtactctcagccaagcattcactgagtttacaggaatcagcaaaacagctggaggaatatcttcaaaaggctcgtcataagcagggcgagtgtttacagccggcgggaacaaataagccgcttcacctttctgatattgcgtatacccttcttgaagggcgtgaagccatgccggaaaggcttgctgtcatttcaaataatatcgatgatctgatgttgaaattaaatcacttttataatggaattgacgatcacgaaatattcagagggaaaaaaccgaatcataaacgcggacagcggcaatcagatcttccgctcaaatccggcagaaccacattagccgaaatggctgaattctgggtatcgggagggaatttaagctgggaagatttccgcaccggcagaaaaccggcaaaaattgcgctgccgacttaccctttcttaaaaaacagactgtgggtatcaaataaggcgcaaacaacatcagcagccggtacagctcctttatttgatttttctgcaggtgagtgccgattttataaaacgctttcagattctgaatattatttaaaagaccatgttgtgcatgggaaaacggttctgcccggagcggcaatcatcgaagcggccagagaagcgggagagaggctgtacggaaaatcagtcataaaactgagtcaggttgtatgggcggttccgataaccgttgaaaaagaaaagacgataatgatagatctgctgccgaatcaaaaagacggcagatttgtggtgaaaaccgatatgcagcctgaagcggcagttcattgccaaggaaacattatcacatgcggagataaagacgcctctcatacagagcattttaaattggacagccggttaaccggacagaaaagattaatcagcggcgctgagtgttataggaacttccggcagagcggtttggactatggagccggctttcaggtaataaaacagctgtttatccatgaaaatgctgttcttgcacgaatatcacttcctgagagcattcataaaaaatccggcgcgctgctggaaccgtgtttattggatggcatttttcaatccacaaccgggtttacgtccactcaggaagacgatcacaccgcatatttgccttttgaattaggtgagctggaaattcttcaaccaccttcggcaagcggctatgcttacattactgctgccgatgaaagacaacatgatgatgtcaaaaggtttcatatactatttatggatgaacacggatctgtaagtcttaaaataaaaaacttagcgttgaaggcattaagggctgcaccgcagactcaaaatgagcggcattcagctaagtattacactgatatgtggaagcgggcccctatgcttcatcagcctgaaggcagcggtttaaacagctgccttgtgatttcactccgtcaggatatatcagaaccgctgatccgccaggcatataaagatatcggcctgaacatgatctttgtccgccatggcggcagttttcaagaaaaagaagctgattcctttgaattgaacagcgtcaaacttgaaggctataagaaattgctggcgattcttaaagaaagacaagtgacaattgaccgcgtcattttaatcgggatgagccctgaaacgggaattgagcataacattcatgaaaagctggaaaaggctgttttgccggttttcaatgtaacgaaagctctgttagcaacaatcccaagacataaaatcctgatatcacatgtatttttcacaaggaacaatcaaatcttaccttatcaaatggcaatgagcggcttttttaggtcgcttcatttagaacatccaatgttgtccggtaaaaatattgaaatacacagcgatggaattcagttacagctgaacaccggtctgcctgaattaaaaaaccttgtgaaagaaacagtcatcagcgatgatgcttcagagatcagatacagagatggaatcaggcaggtgaaacactctgcagaaattgaaagggcagagccctccaaaaagatggaagtaaaagaagggggagtttacctcattacaggaggaacaggcggtctgggactgattttcgccagacatcttgtgcgaaaagggagaataaaacttgtgcttatcggcaggtcagagctttctgaggaagccgtaagcaatgtaaaagagctcgaaaaaaacggatcagaggttttttatgtaagaaccgatatttctgataaggaaaatgtcaacaacctgataaaactcgtcaaaaacaaattaggtcctgttaaaggaattattcacagcgccggtgtgataaaagattcattactcatcaataagcgtgaagaggatctcgattcagtcttggccagcaaggtttacggaacgatatggcttgaccggtatacagacagagaacctctggacttttttgttatgttttcatctatcagcgcaataatcgggaatgccggacaaactgattatgcttatgcaaaccggtttatggattattttgcggaaatgagagcggcggaaaataaacctggaaaaacagtctcgattaattggcctttatggaaagaaggcggtatgcaaattgacattcattcagagaagttcctttatgaccgtttcggaatgctgcctctggaaaaacgggaaggccttgcagcatttgatcaagcaatgacagggtgtgaacatcaaataatggtatttagcggtaatgaattaaagctggaacgaatgataacgattgacagcggaaaaagtgacccggcaatcgccgacgaaaatcacgaaccgaaagagctgtcaataactgaatctttaaaaagcactttgacgcgcatcatcaccggcgtattaaaaattgaagaacgggaatttgattttgaactgccgataagcgaatacggatttgattcaattatgtttacaatgctgggcaacgaattaaacgaaacattaggaatatcaatgatgccgtcagattttttcggtcttactgattttaatgaacttcttgagtttttaaagagtgagtattccgaagagcttcatctctgcgggtctttttcttcagatgaatctgcggcgaaagacagaagagaaaatctgattgagggcatcgcaaagatgatgtcaagtattttaaagattgacagaaaggaaatagaagaagagacttcattcggcgagtacggatttgattctattacgtttaccagactcggaaatgaaatcaatcaacaatatggtacggaattattgccgtccattttctttgaatgcaattcactggctgaactgactgattatgtaatcgagcaatacggagaaatcctttttgctgagacagaacctttttctgcagcagacgaaaaaacattgtacagcacgcctccgcccgaatcctatgaacattcccctgagcctgaaaacaaaaccaggcaagaggaaagacatatgaatgagccggttgcaatagtgggaataagcggccgtttcccccaaacagatacgctggaagacttttgggaaggaattgaaaaagggcgggatatgattacagacattcctgaagaccgttgggactggaaagagtttgacggcgatccgatcagggacgttaatagaacaaaaataaaaaaaggcgggtttatcaaaggcgcggacagttttgatccgttgtttttcgggatttctcccgccgaagcagaattaatggatccccagcaaagaatttttatggagactgtatggaaaacaatagaagatgcgggctataagccgtctgatttggcagggacgaaaactgcggtgtttgcaggggtcgccacaacggactatgcggaacgtctcaatgaaaatggcgtctctgttcaggcgcagaccgcaaccggtttaaatcattgtatattggctaatcgtatttcttaccagctgaacctgacgggtccgagtgaaccgattgatactgcctgttcaagttcgttagttgcactccatcgtgcggctgaggggattcaaagaggcgattttgaaatggcgattgcaggcggagtgcatattatgacaagccctactctgtttatagcttttgataaagcaggtatgctttccaaagacggaaagtgcaaaacgtttgataaaagcgctgacggctatgtaaggagtgaaggggcggctgcagtattgcttaagccgctcagcaaagcacaggcagacggtgatcatatttatggtttgattaaagggtcagctgtaaatcacggcggccgcgccaattctttgacagctccgaatccgaacgcacaggcggacttattaaccgaagcttggcggaaggcgggggtcagtcccgccactgcgggatatatagaagcgcatggcacagggacaagtcttggcgatccgattgaagtaaacagcatcataaaggcatttaaaacgttatatcaagaatgggacattccttttgagaaacagaaaagctgcggaatcgggtctgtgaaaacaaacatcggccatctcgaaaccgctgccggaatagccggagtgctgaaagtattactggcttttaaatatcgcaaacttccgggactcgcccatttttcagaactcaatccatacatcaaactggaaaatacgccattttatatcacagaaaccgctcaaaagtggaatccgataaaagatgaagagaacaacgatctgccgaggagagcaggtatcagctcattcggattcggcggtgtgaacgcgcatattgttttagaggaatataggaaacctcaaaaagaagtgccggaaaacaacggtaaaacacacatttttgttttatctgcgaaaaccaaagatcaattacttgagtatatccggcttatggttcattacttggatcgcgtgattgccggtgacatgaccgttaatgccagtgacatggaatttacattgcaaaacggccgggaagcaatgaacgaaagaattgccgtatgtgcagcgagtctgactgagctgagagataaatacgtcagcttttttgatgacagcaaggtgcaaaaaggcgtatttataagcgaaaacactgaagagcgcgcagctgtttctgaatatatgattcaggaggctcttcaaagcggaaaagaggagctgctcgcacaatggtgggccaatggagccgagtttgaatggaagacaatcggcaataagaaattgaatagagtgccgctgccgtcttatccgtttgcaaaagagagttattggtttactccgaaaaagaacaaaagcgaggttaatagcaaaagtcttcacccattaatcagcgagaatgtctcaacattaaagaaacaagcatttaaaactgttatttccggaactgaatttttcgtcactgatcaccttgtttcaggagactgtgtgttgccgggagccgcttcgcttgaaatggctcttgtttgtgcggaaataagcggagaaagtaaagtatataaaataaaagacgtgatgtggaacagacctatattatataaaggaaaaacgctgcacatttataccggcttggaaatgaaacaagataagttgaacgtaacgatatgtaaagagggcccggatggcgtgcagcaaatctgcacacaatgtgaaacagtattcggagacataaacagcaatcctgagtatgtcgatattgataagtccatacgccgcagtaaaacggtcataagccggaaagagtgttatcaccgcttcagtcgtatgggcctgacatatcagagcggttttcaaacgttgaaagccgtatatcgcggtgatgtggagttaatggcagaattggagcttccggatcatttagcgaacgggttttcacattttacactccatccttcattaattgacggcggttttcaagcggcggcatttttgttaagagaaaatgagaaagacggcttatttgttccttattcacttagagagcttcacattaagagggcgcttactgcccgatgccatgtttcggtgagagaaaccggtttttatacgtataacattgattttattaacgagagcggcgaaatagccgtgagcatgaaagacttctctgtcagaaaagtgaccgggggagaattaaccgcaggtcataaaaatgaagatcaggaaattctcttcttattggaacaattgaaaaacggtgaactttctgctgaccaagtttatcagctgctggagggaaaatagtgcagatcaaacaaatactttccttaattgaagaacagcaaatgtctcctgatgcaggactggagctaattcgcacttacagaaaagaacaaatggaaaaaaaggcggagccgggatcacaagctccgtccccaaccattttttttaagaccgattgggtaaggacaaatcacattgatatgccgaatcagcaggcaccggggaatatgctgatttttgatcaggataaccgtctctttcagcatgccgagatgatgaatggagaacataaccgtgtcattctcgtaacgcccgattctgattacagaattgaacggaatagatgcacaatcaatccttctgatgaacatcatgtcgaaatgctgctgtctgatttggctgaaaacggatttacacctgatgtcgtgctttatttatggaacggagaaatcagagaaatcactgaagaatccgttaatgaaactcttcgcagagggataaactcgctctttttattatcaaaagctttaatgcgaagaaacgaacctgttacgttattgcatatttattggaaaagcggtctgaatcagccgtttcatgaagctgtcggagggtacatgaagacggtaaacatggaaagctccaagcttaaagcgaaaaccatacagatacgccacgaggattctgacataaatcctccggtttccgagatgtgggatgctgcaatcagtgaaatgcagcgcagtcaaacggatgaatgtgaggttttaatagactcatatacccgttatgtgaaagagctgcagcctattgatattccggaacacgatcacggatctgtaacgtatcaaaaaggcggcatatatatcattaccggaggagccggaaaactcgggctgctgtttgcggaacacatcgctaatgaaaaccaagccgtgattatacttacaggccgttcttttttaacagctgatcaaaaagaacggatcagtaagcttaatgagagcggctctattgttgaatatcagcggacggacataacagatcgaacagaggcagagcgattcattttcggcgttaaacagcggtacggcagcataaacgggatcatccatgctgccggcatccttcgtgactcatttcttgtaaataaaagtctcagtgattttacggacgtactgaaaccgaaagtttacgggacaatctggctggatgagctgacaaaagacgaagatcttgatttttttgttctcttttcttcttttgccgcttacggaaatgccggccaaagtgactatgcgtacgcaaatcattttatggacagttttgcaatgcttcgatcccagctctctcgaaacggaaaaacactatcaatcaattggccgttattgaaagatggcggaatgagtctcgacagcaatggaatcattcaaataaaagaaaaatacggaatgactccgatgcgaacttcctctgttctggaagcgtttctgaaaatgctggggtcttcatttaccagcttaatgcctgcagaaggtgagcggaataaaatgataaaagcgctttcgattcaaagaaatacagctgcagcagatcaagatacactcacggcggaatacgatgaagaagaggaatatgctgcgaaagaaaaagtcaatgactatttaatcaagatcatcagcggtgtcttgaaaatccaagctcataaaataaatgcgaaagactcttttgagaagttcggaatcaactcacttatgatcatgtcacttatttcaaagcttgaagatactttcggggatcttccgaaaacaatcttttttgaatatcagaacattgaagagctttcaaacttcttcctaacatcttttaaagaaaaagtccttaaggccgcaggggcagctccggtaacaagagtgcagaagaaaagagaaaatccgagtaaaaaacagcaccggcagcagaaggatacacctgcaccgagcatggttcagccgggtgaggatattgccattatcggtgtgagcggaagatatccgaattccgatactcttgaggagttctgggaaaacattgccggagggaaaaactgtattattgaaatccccgaggaacgttgggatttcagatcaatttacagtcccgacagaatggagaaggggaaaatcaacagtaagtggggcggttttatcagcggtgttgatcaattcgatccgctgtttttccatatttctcataaagaagctgagctgatggaccctcaggagcgaatttttctcgaaacctcctggcatacgtttgaagattcaggatatacaaaagagaagcttaacggtatgaaagccggtgtgtttgtcggagccatgtacggacaatatcaattattcggcgcagaagaaactgcgcggggcaatccgattgcgctcagttccttcttttcatctattgcgaacagggtttcatacttttttaatctctccggcccgagcattgcactggatacgatgtgttcatcatcgctgacggccattcacttggcatgtgagagcattaaaagaggggaaagtgaaattgcgcttgcgggcggcgttaatgtgtccatacaccccagcaaatacctttggctgagtcaaggtaattttgtttccaccgaaggattgtgcagaagtttcggagagggcggagacggctatgtcccgggagaaggttcgggagccgtcctgttgaaacctctggaaaaagcaattgctgatcaggatcatatatacggagtgattaaaggaacatctgtaaatcatggcggaaaaaccaatgggtttacggttccgaatccgaatgcacaagctgagctgattgctgaaaatttcaagaaatcgggcatcagtccgcgatccgtcagctacttggaagcacacggaacgggtacctcgctcggagatccgattgagatcgcaggattgacaaaagcttttgagaaatttacggatgataaacaattttgtgccataggttcagtgaagtctaatatcggacatttggagtctgccgcaggtatagcagcccttacaaaagttcttttgcaatttaagcaccagaaattggcgccatccattcactcggaacagctgaaccaaaatatccgatttgaaaagacgcctttttacgttcagcagaaagaagaagagtggcggaaagaatcaggcgcctctaacaggagagcagcaatcagttcgttcggagcgggaggagcaaatgcccatgtcattgtggaggaatatcaaaaccatgcggacacacaaacaataagcggtccgtttgccgcagttctctctgccaaaaatgaagacagactgaaagaatacgcccggcgccttctgcaattcacagagcgggagacaacagcctcggcagctgatatcgcttttacattgcagacatgcagggagccgatggaagacagacttgctgttgtagcttccgatttgccggaacttaaggagaagctgagaactttctgtactgaaggaacaattggagagggcgtatacaaaggcaatgttacgaaagactttgataaagtctttatctttcatgatcaaaagatgaaagataaattcctcgaagtgatgatggagacaaaggacttgaatcttctagcaaaattatggtctttcggggctgatattcaatggagagagttatatgaagagtatactccgcaaaaggtcaagcttcctttatatccatttgctgaggagtcttactgggtgcctcgaaatcaaagtgcaatagttccggaaatattgccgcggcagtcttcactgcacccgcttctggattcgaatgaatctactctggaacagcagttttttaaaacgacattaagagaaaaagagatttggttaaaagaccacatcgtaaaaaacaagagcattctcccggcagctgcttttcttgaaatggcatgcgcagcgggaacgcggtcatatcgaaagaaagaggtcactcgtttaaaaaacgtgatatttgcaagaccggccatgcttttgcaagagagcctgaccatttacactcacatttccgtaaaagacggcaaaatattatttaatatgtcatctgacgaggatgctgctgtaaggaatggatttgtgacgggggaattagattatgatcatcattacgatgatgatatagagaatatcgacagacaagagatgataaacagaagtgcttttgtccgtgaacaagatgaatgttacaagtattttcgggaaaacgggttcctgtatgggcgcgcttttcagccgattcaacgtttatggggcggaaaaacagaagcggttgcacacttattgctgccaaaagaagccgcatatgcacttgaaaattatacaatgcatccgtctttaattgatggggctctgcaatctttgttcgggattacggacggaagagaagaggcatctgtttatgttcctttttcaataggtgagattacgattcggaaaaaagtttcagcagaatgctgggcttatgcgcgtaaaacaggccaaaaaggtcaatccgagcttatttacgatattcagctgcttaatgaacaaggagaaagacttgcaggtttgaaggatgtaaccattcgtaaaaaagaaacgttttccgcggaggcacagactcgtgcaacagcggattccaatggaaagaacgagagagtaaaagagctcctcagacaattaaaagcgggcgaactgactgcggaggaagctgattatgtgctggagcgcatgcaggattagtttatcattttgcggaagtgccatttgtaaaggggatgaagatttttatgaaagaagcccgtcatattagaaaaaaagtactttctgacatagaaagcggcaacatttctttggaagaaggagtaaagcggatacagcagcttggttttcattccgcaggggttaacggacaggcgatatattatcagacggtctggcagcggacagatctcagcattcatgtaaaaggcggccggcgtgagggcagccttttattatttgataaaaatgaagatgtgagtaaagaacttgctgcattgcatgatacaagggttattttggttaagccggggaaagagtttcgaaaaaccggggacggtgtatttgaaatcgacccccgctctgaaaaagattacatagacctgttaggatggcttatagaagaagaaaagtcagatatacgggaagcggtgcatttatggtcagacatgccgtttgaaaaaacagagagagcgattcgtgaacaatgcgacagcggagtcaattctttgtttttattacaacaggcgctcttcaaaaataactgccgcaaaccgatcaagctgttatatggatatttttcgcatctttccggagaacagcctctttacgcggcggcaagcggatttttgcggacattgcagctggaaaatccgttaatctcagcaaaaagcattgaaatggagcagtcaatagcagccgttcacgcagctgatatcatacgcaatgagctgaactatttccagccttcagatgtagagatccgttataaagacatgcagcgttatgtcaaacacctcaaaacgtatgaacccgaaaaaaattccggaagcggagatgtgccgctgagagaaaatggagtatatattatcgcgggcggcgcgggcggattaggatttacctttgcagaatatttggcttttcaaacaaaatgctgccttgttttaacaggaagatctccgctttcagaccatataagaaaacagctgaggcgattggaggatgccggttcttcagctgtttatgttcaggctgatattaccaataaggaagaagccgaatatgtagtcaaaaaagccaaaacttcttatggaaaagtaaacggggtcattcagggcgcgggaatcatccgtgactctttccttcttaacaagtcacgagaggaattcgatcaggtaatcagaccgaaagtattgggtacgatgtggctgaatgatgctgttgagaaagaaaatcctgactttttcatttgcttctcctctacttccgcagtgttgggaaatgtcgggcaatctgattacgcgtttggaaacagctatatggatcatttcatgaatatgcgttctgcccagcattctgatacgatttctctctctctgaactggccgctgtggaaagaagtcggcatgcaagtggatgagcgcacggtagagacaatgaaaaaggcgggtttttatcctttagaaaaagaagaaggtaaaaaagcgtttgcagtcgcaatgtcctccggtttttcgcaatttactgtattttacggagatgagcaaattgacaaccatgttactcaattatatgaacgaaaagacagcattcaggcagatgaaggaaaagggagaaatatcgaatcatttgattcagagaaactgacagctgaaacatctgattttatcataaaaataattgctgcagaattcaggatgcctgcggacaaaatagatgcagaagaggcattggaaaaatacggacttgattccgttatgattatcaatatgacgaatgagcttgaaaaacatttcggcgcgctctcaaaaacgctgttattcgaatatcagactgcggcagaattgtcacagtatttcgttgaggagcacagggatactcttcttcataaactccggttaggagaaaacgggagcggcaccccatctcagaagaaaaaagataataaacagacagccgatgttaacgggaaacagaaaatccagatgaaaaatcaggtccagcaggagaagtatcatgacaatgatatcgctattatcggtatcagcggacgttacccgatggcaaatgatcttgatactctgtgggaaaacttattgaacggtaaagactgtataactgagatacctgaggatcggtgggattcggggctgcactatcagcctgcggcgggcgacgaagtaaaaaaccaaagcaaatggggggatttattgacgatgtgtatcattttgatccgttgttctttaatatttctcctgccgaagctgaattaattgatccgcaggaaagactgtttttagagacggtttggcacaccatagaagatgccgggtacgcaaagaaaacgcttgaaagaaaaaacgtcggtgtttttgcaggggttatgtacggccaatatcagctgtacagcgttggtcacgaagcggccgtttcttcctcatatgcatcaatcgcaaaccgggtatcctacttctttaatttcagcgggccaagtattgctttggacacgatgtgttcctcatcattaacggctgttcattttgcctgtgaaagtttaatcaggaatgaatgtgaatttgcaattgcaggaggcgtcaatttatccattcatcctcataaatacgaactcctgactcaaggcggatttttatccagtgatggccggtgcagaagcttcggttcaggaggagacggctatgtgccgggagaagggacaggtgccgtgctgctgaaacctgtaaaaaaggctattgccgacggtgatcagatttattcagttattaaggcaacagcgatcaaccacggtgctaagacgaatggatataccgtgccgaatccaaaagctcaaagtgaggtcattacgagagccttaaaaaaaggatgtattgatccaaaaagcatcagctatatagaggctcacggaacaggcaccgcgttaggagatccgattgaaatcaccggtctgaccaaagcattttcaggtgccgaacgcgataagaagacatgcgcgatcggatcggttaaatcaaatatcggacatcttgaggctgctgcaggcatagcgggcattacgaaagttattcttcaaatgaaacataaaacgattgttccgtcactgactcattctgctgaattgaatgaaaatataccgtttcaaaaaacacctttttatgtaccgggcagtgcagaaaaatgggagtcatccgttcccaggcgtgccggaatcagttctttcggggcaggaggagctaatgcccatgttattttagaagaatttacggatgaggctttctcttctctcccggctgaagaacctgaacagcttttatttgttttttctgcaaaaaatgccgacaggctggcagaatatgcaaaacgcgcaaaagaacatatagcagccagagattatccattagaaacacttagaaatacagcatttactttacaaaccggcagagaagaaatgccgcacagattggctgttatcgcctccacaagagatgaattgcttaaagggctgacagactatactctcggaaacgcgagggatcatatttttacaagcggcaaagacacaacagaagctcaaaggatgaacaaagctgagattgaagaagcagccgcaaacagggatcttgtgaagattgctgaatactgggttggcggtaacggagtagattggccgtcactttataaagatgtcactttgagacgggtatcagcacccggatatccatttgccaaagagctatgcagaatagatgcgcaaaatacgggaagccgctttatgaacgtaaataacgatctgcatccttacatttcatgcaatatatctgattttaaagcacagaagtttcttatcaatgtaagcgataccaatttgtatataaaaacaaagtatcaagacaaggaaatgtttccgtttctcagccagattgaaatggcgagagctgccggagcgatggcttcaggaaatccgattattaaattaactgagctctcctttagagaaccgatgttacaaagcgaaagcaatgagcagatccggattgtattaaccccggataatcagggtgcatcgtattctatagaaaaacagagcgactcatccatttattcctcagggcggatcgaattagaagacggggcgtacgagaacggaaatattcatcttgagccgtttctgtctcagcgtgcagaccggataccgtacgaagcgttttatcagcggcttgccgaattcggatacagctgcagtgacagtctgaaagcggcagagcactgcgtcagcaggaacggacaggtgcttttaaagataaaagcaaaggccgggccgaaagggtgcataatcaaaccggaagtgattgagagcgcatatcaagccgtcatataccttgcgggggaaaatgccggagagctcccggaaaatattaaagaatgtacgatttttgatcatgagactgaacccgtttatgtatatgcagaacaaactgaagaaagcgattcggcttatgatgtgtatgtattagacaatgccggcgggattttgatggaactgagcgggctggtttttggcgaaaagcctaataaaaatgtacgtttttatgagcataagtgggatcaaaaaaaccctctgattgaaatgaaagatagggagccaaaaacaattctggtttttgcaaaagatgaagcattggctggagctctgaaaaatcaatcagacagccgtgtcattctcgtcacgccggatcagcggcagaccgatcaaaatctgctgacattctgtataaacccggaagtgacgtcagattatattcgtttattcgaagaattggagaaaaaggggttttctcctgatgtcatcttgcacacgggagaaacattttacgcgggtgaccgccttctcagcggcctggaatcaattttttatttattaaaagccctgagcgcccgcaatgatgcctctctttatctgcattctctgcttcttgttcactcttttaaagaaggcgtgaatgatccgtatacgggcgctcttgcaggctgtttaaaaacggcaaatatgttggtgccatccgcagagaatgtgaagtcaatcggtttttcagaacgtatatcaattgaaaaaatggctgaattttgtcttaacgaaatggtttcaggcgtggaacggcaggcggaagaagttaaatatataaatgacaagaggtatgttaagacattaaaggagtatgtattcaatcatacagagcactctcatcagctgaaacagaaagggatttacctcataacgggcggtttgggcggtctgggcctgattttcgcaaaatatttagcctctcagtatcaagcaaaattggtattgacgggaaggtcaccgttaacagctgataaacgccataacattgaccggctgcaggcgcttggaggagacgcggtatattatcaagctgatgccgcagatcaaaagacgatgggatgggtcatagaagaaacgaaacggacttggggctcccttcaaggcgttattcattcagctggtcatgccgatgatcggttatttacagagatgaatctgactgattttacggaaggcatgactgctaaaattgaaggaacggtatgcttagatgaattaacgaaagatgagccgcttgatttctttatcgtattttcttctatgtcttcggtcttcggagattttggacaggttaactatgcgatgggcaattattttcaagatcaatatataaattggagatccgaacagagccgccggcaagagagacaaggcaagagcatttcgattaactggccgttgtggcgtaaaggcggaatgcatttaaacaaagaagctgaagacgcatatctttccgcatccgggtttgattatttggaaacggaagaagggatagcggcttttgagacaattttggcaagtgactgtccgcaaatttcggttgttaccggggatgccggaacaacaccagcaaaaaatgatctgccgcatcaaaaagtaaatacacttccggttcgtcaagaggaaagttcttatacaggaccggattctgcagacaatgtccttgaagaactgaagcaaatggtgtcggaattattgaaaataaacattgaacagctggatacggcagagaatttcggcaatctcggctttgattctatcagtttgaaaacattagctgtcagactgaataaaaaatacaagcttaagctgacacctgccgttttctttacttacagccatataaagtctctttcagaatttctaagcagtgaactgcgtactgttgcaaaagggaatacagatgcagaaaaaaccatttctgaaaaaaggaaagtagtgcacgccgggaaaaccgcagggaaaaccgtgaagccgccgcgaagttttccgtttgaaaaaaagacagcaagacaggctgaccatcatccggagaagcagccggttgccattatcgggatgagttgtgtttttccgggagcaaaaaatgcagatgagttttggatcaatttaatcaatgaaaaagattcgattcaggaaattcccccggatcgatgggattggaaaaaatacgccgaaggcaaaggaagcagcgaagtacattcgaaatggggcggatttatcacagatgccgataaatttgatgaggcgtttttcaatattaatccgcgggaagcagaactcatggatcctcagcacagaatttatttgcaggaaacctggaaagcgatagaagatgcgggttacaaagcttcaaagctgtcaggcaaacatatcggggtgtttacgggcattcaatttaatgattaccgccagctgctgatgaggcattcggacggggcgcatgcgtttgcgggaaccggaaacagccaggcgctcatcagcaatcgtgtatcccactattttaatttcagaggtccgagtgagtccattgatacagcctgctcaagcagtcttgtagcaatccacagagctgtgcgctcgattcaaaatggtgaaagtgagctggcggtagcaggcggggtttcgctgcttttagatccagtcacgcatatgtataccgataaactcggtattttgtctagggacggccggtgtaagacgtttgataaacttgccgacggttatgtccgcggtgaaggtgcagctgttctgttattgaaaccattgcaagcggcaatgaatgacagagacaatatttacggagtcctgagaggaaccggagaaaatcacggaggaagatctgcttcattgaccgctccgaacccggaagctcaggcagaactgttaacgtctgtttataaaaatgccgatattcctgttgatacgatatcttatattgaagcacacggaaccggaacagaactgggagatccgattgagattgaaggcttgaaaaaagcgtttggatcttttgagccgcatccaggaaagaatcatgaccaatattgcggcatcggttcagtaaaaacgaatatcggtcatttagagcccgcctctggaatgccggggctgattaaagtattactatccatgaagtataaaacattgcctgccacacttcatgtcaaggagctgaacccttacattcaattaagcggaacaccgtttcatattgtcaataaaactatgaagtgggccagattaaaagatcgaaaaggaaatgaaattccgcgccgtgccggagtcagttcctttggattcggcggggcaaatgctcatgtcatcgtggaagaatttgaatacggacaagataaagcagtaactgccgagcgggatcaaatcattgttctatcggccaaaacaaaggaaaggctgatggttaaagccaaagagttaacagcgtttttacatgaagaactatcagttcaattcagtcagcaagaggtgcaggaacgtgatgtgcaagaggcggttcgggaagcggcagcgggtatcctgcgtttagataccgcaaatatagatgcaaagacacctctttcggaattcggatttgatccgttggcttattccgaattaatctcttttataaaccaaatgtacggcacagaaatatcactagacatatttcaggaattaatgaccctgagcgagctgtgccgctatatcagcagcgtgcggaatcgatcagctgataaaccgtataacggcaattttagagaaaagtccggaatcggtcttgaagaaatagcatatacgctgcaaaccggaagggaaccatttgaatgccgccttgcgatcacttgctcgaatatcggagatcttcttgaaaaattaaacggttacattcaggggagcaggctgcaaggtgtttatgaaggaaatgtaacggattttgatagtctgtacgctcctttattcggcggccccgaaggtcatgcatatgttcaatcactgattcagcaaaacaagccggccaaactggctcagttgtggacgatcggttgtgaaatcagctgggaagacttgtatgaggaggaactcaaaccggttaaactgtctcttcctctttatcctttcagcaagaacagacattggattcatttaaataaagatgaagcgcagaaggctgaggctttctcgaacactgagcttcacaactcaaataaagatacagcagatggagaaatcatgtcgcttcttgaaaaagcacaaacaggtgaaatgaatacgaaagagacgtcagagctgatagaggagttgcttttccatgaatgaaaaaacgatgcaaattgagcaaatcgtgaaaaaggtgaaagaaggcagcctgacgcgtgaagaagggctggaattaattaagagcttggggaaaacccatctatatgaaatggtatgggatagacatgaatttaaaggcagtgaaaaattcccgaatacgaaagagccaattttatttttttgcaaagacgacagcatgtataccgtaatgaagagacagcttgaaggttatgaggcgcctttcatttacgtgacttccggcgagcgtttcgaagattgccggaacggtcgttttaaaatgaactttgcaaaagataaggattatgatgcgttatgcggggttctgcgttctcaaaatataagaccccgccatattattcattttttagctgccgggctcttcaaaaatacagaagatgcaatgagaaagcagctcaataaaagtctgttttccttgtttcaaatgtttcaggccttcatggcgaacaaactttgtccgaaagcagaaattttgtatctgtatgaaaataccgagggcgaggttcagcccatttataacgcggttgaaagttttcttaagaccgtacaggccgaaaacccgaatttcacatgtaaggctgcagagctgaaatcaatgtttgacgagccgtttacaaagcagcatattgcagatgtcatctcttttgaatggaacaatcaatgcaagacggaccactttacctgttatgagccgagacattattataaaaggcagcttaaaagagtaaaaaaagaagatggggagaaacatagtttcagtgtaaaaaagaacggtgtgtatttaattacgggaggagccggcggtctcgggtatctgtttgcggaatatctggcgaaacaggcagaagtcaagctggtattaaccgggcgttccccggcatcccgtgaaacggcgcaaaaattgagcgctcttgaaaatcgcggcgctgaagccttatatgtcccggcagatatttcaaaggaaaaagaggcggacgcgttaattaagcacattaagcagacattcggagaattaaacggaattttgcacagtgccggacttgttaaggatgcatttatcataaaaaaagcgaaagaaagcatagaagaagttatagcgcctaaagtattcggaaccgtttggctggataaagcagctgaagaagagcctcttgatttcttcgttatgttttcatccctttcggccgttctgcctaatgcgggtcagagcgactacgccttcgctaacggatgtatggacggattcacccagtatcgaagcatgaagggacgtcccgggaaaacactttctattaattggcctttatgggatgcggggaatatgacagttggtccggcagagctgcaggctttaagacacacggggctggaacttttatctgcccaagcagggcttgccgcttttcaggacagtatgagccgttctgcttctcagctggctgttatcagcggagacaaagatagaataagtgaattactctcaactgaccataaaaagatagagactgtgcctgaaaacaacagtctgccgcaattaaatgaaaaagatctgaaaaagcaaacggtccgtctattgacagagattgtcggtgcggaaacgggaagaccggcggacagcattttacccgaggatacatttgaccgttacggaattgattctctaacgattttaggtcttaactcccgtctggaaaagtattttggaagagtgtctaagactcttttctttgaatacagcagtgttgaagagttgtcagagtattttcttgaacactatcaacatgagttgaagaaggcgtttttaccggcagccgaacagcgaattgatcattcggcgccggcgaaacgggagaagctttccgtttcccgcataccatccgcaccttccgaggaagatattgcaattatcggtatagccggccgctacccgatggcgaaggatgtggaacagttttgggaaaatatttcttccggaaaagattgtataacggaaataccgaaagagcgctgggattttcggaaatattatcacacgggtgacaatgcccgtcatgacagcaaatggggaggttttataaaagacgctgataaattcgatccgctgttcttctcaatttcgcctcgtgatgccgagttaattgatcctcaggaacggttatttttagagacagcatggcacacgtttgaagatgcgggttacacaaagaaaaagttgaaacggcataagacaggtgtatttgtcggcgtcacctacagccactatcagttatttgcagccggtgcttcagatgatgagggacgtcaggcgctcttatcttcttattcgtctatcgcaaaccgggtgtcatatttctttgacctgcacggacccagccttgcaattgatacaatgtgttcttcttcactttctgctgttcattttgcatgtgaaagtataaaaaggggagaatccaccctcgccatagcgggaggagtgaatttatccttacacccggataaatatactttactttctcaaaatcattttgtttcaagcgatgggcgctgcagaagctttggagcgggaggagacggatatgtgccgggagaaggagtcggggccgttcttttgaaaacgctttctgccgcaaaggctgacggggacaggatttacggtgtgattaagggaacatctgtaaatcacggcgggaaaacaaacggatacactgtgccaaatccgggcgagcaggcaaacgtcatcagtgaaactcttgataaggcggggattgatgcagacagcataagttatattgaagcgcatggcaccgggacatctttgggagacccgattgaaatttcaggtttaaccaaagctttgcacagctcgaaaagcgattatcgttgtgcaattggttcggttaagtcaaatatcggacacctagaggccgcggctggaattgcttctatcacaaaagtgctgatgcaaatgaagtataaacagcttgctccttcccttcattccgataacttaaatcctaatattgattttgaggaaacaccgttttacgtgcagtctgaactgactgattggaagacgccgcaaaatcaagcaagaaggtcgggcatcagttcgttcggcgctggaggatctaatgcccacatcatcatcgaagagtataagaatgaagaaaagatggaaacggtacagagcaacaaggcgcaaattattctgctttctgccaaaaatgaagaacggctcagactcttgattgatgcatatataaaagaactggagccaaaaacgtcactagctgatgccgcgtacacctcgcagaccgggagaaacgctatggaagagcggctcgctgttgaggttagcagcattgacgatcttcgcaataagctgacgatgtatttgcggtcagatcataagttaaacggtttatataggggaaaggcccgccgaggcgctggtcaaaagaatgccctgtcagccgctcactttgaaaatgcaagagatatgtccattcactgggtgaacggaggagacgttgaatgggaagaaatgtacactgcggaattaccgaagcttatctctcttcctgcatatccttttgaacggaacagatattgggtgcctgccgctaaagcagcagagaaacagaaaaaaacaggtgtaccgcagagtctgccccatgcaccgactgacttatcatttgatgtattaaaaaaatcgtggaaaaaacaaaaggctgcgccttccgcttttacgaaaggacaggtgatgatcctggctaatagtgaaagtgagcggcttgcattcgaattgtttgattcagatcctctgattgaatccgctgtcatttgcgcagataactgggatcaatcggatggggaagccaaaaaaacggctctagcagtcatagaagaaaatccggaaatcatcggcatgattgacctgtcagatttgcggagtaatcaaaacggggcacgcaccggcacaatcgggaagctgacactgctgcaggaaatcataaagacacgtaaacagcttttcgttttacatgtgacaagagggctgcagacatttctgaatgacaagccgtcgttagccggagccgaaacagccggactatataaaatgctgagcgcggagtatcaaaagataaaatcaaaaacaatagatgtagacgggcatgtcgggactgcggcggaactgagacaggtaatcacagatgaagcttgcgctgacgggctgtatagtgaaatctgctaccggaacggtgaacgttatattccatacgtcgagaaattacatgcagcggaaataaaccggaaactatccggtctgccggtctgccgtacggatcaaaccttggttattacagggggaacaagagggatcggagcagaacttgccagacattatgccggcaagggagtcaaaaaacttgtgctgatgggagtaaccgaccttccggaatctgataaaatagccggcatgttagaagacaccgatgaaaagtcacctctttattcgaaattacaactgctgcatgagttggatcaaaagggagttcaggtggaagtgtattccgggccgctcacggaaaaagaaaaattacatcgcttcttttcagaggtgagaatgaagttcggcaaaatcggcggggtgattcattgcgctggtgcagccaatcattcgaatccggcttttatccataaatctgataaagaaataagagaagtatttgagccaaaggttcaagggatgcaggtacttcatgacatttttattgatgacgaacttgatttcttcattttgttttcatctgttgcgagcgcttttcctttattaggcgccggaacaagtgactatgccgcggcgaacgcttttatggattactttgcggcgtatcagcatgcagccggcagaacatattatcaatcaattaactggccgagctggaaggacattggaatgggcgaggtgacaagtccatcatatcaggcactcggtttactttcacactcaacagaaacaggtatttctatgctagatgaaatcatgacgataaacggatatccatgccttataccggcaaagacacatcaggagaaattcaagctgcagcagctgcttcagacaagaattcaagctgctaaaaataacccggatgctgaggaaaaagtgatctctggtcatggagacaatgaagctatgatcaggaagttaatggagattttttccgcagagctgaaaataccttacgggaaattagatcaggatacgtcttttgcggattacggagttgattcaatcttactcgttcagcttgtcaaaaaagcggaagatgcatttcaaataaaaattgaaccttcggcttttctggagtatccgagtttttcacaactgggcgcctatttgaacgagttatttgcaagtgaggggatcagtcctcaaattaattcagaaaacattgaggttcggaaaaaagagcaacatataaatcaaaatgcttccgaagtacgggacagcggatctcaaatgcaaccaaccagtctgaaccaaatcgctattatcggaatgggctgtgagtttccggatgctccggacacagaaacgttctggagaaatttgaagaaaggacaaaatagtgtccgtgaagtcccggcgtcgcgatgggatatttcttcatactactctgacacctatgaaaaaggaaaaagtatcagtaagtggggcggatttcttcaagatattgagtctttcgatcccgcgttttttaatatgaacaaaagtgaagcatcagagcttgatccgttaatcaaaaaatgccttgaggtcagcgtccagacattgagagacggcggctatacaaaagaagaagtatcaaacaaagaagtcggcgttttcatcggttcgcggaccgggacgtttatgtccaaaataggttcaccttcaaaaaatacgatcgtgggtataggacaaaatttcataggcgcgcatatctcacatttttttaatctgaaaggaccgaatctggttgtagacacggcatgttcttcctcattggtcagcgtccatctcgcttgtcaaagcctgatgtcaaaagagtcagatatggcgattgcgggcggggttgacattttgctggatcaaaagccttacgtcatgctgagtgaggctcgggcgctttcacctgaaggaaaatgtcatacatttgatgaaaaggcagatggatttgtaccgggagaaggatgcggcgcagtccttttgaaaagacttgatgacgcccttgccgaaggtgacagaatttacgcggtaattgactcatccgcggttaataatgacggacagacaatgggaatgacaacacctaatccgaaagcgcaaagcgcagtgataaaaaaagccctgaaaaaaggcggaattgatgcagatactctcagttatgtcgagacgcatggcaccggtacgatgataggagatccgattgaattaaaagcgctgactgaagtgttccgggaggttacggaagaaacgcaattttgcggagtaggcagcgtaaaaacgaatttcggacatttaatgagcgcagcggggatagcgagtattataaaggttgccttatccataaaaaatcagatgctcccgccgacattacattgtaaaacgccaaatccgcgttttaaatttgatcagtcgccattctttccgaacacgtctttaaaagaatggcgtcccagaaaaggggttttgagagccggaatcagttcttttggattcgggggcacgaacgcacatatgatattgagcgacagccatctcacattaggatatggagagacaaaaagacacccgctttctccggttatattcaataaggaacaatgctggatcgacaatggagaaactccagaaaaggaagagtcagaattgctgattcctttacttgatttcaaagaattataaagaaaagaaaaggaatgagacaggtggccagtaatcaaaactatcagttcacattaacaattaaacatacggactatattgtcagggatcaccgggtgcatggcacccggattatacccggtgtcacatttttagatatgatataccgtatggcgctgagtaaaggtttgcctattgaagaactcgagtgtcagaatattttgtatttggaacctgtagcaacatcggatacctttgacagagaaatccgcatccgttttcagggattggaacagggatgggaaatccaggcgaagagcagaaaggtaaaagatgaccgcattctggatgaaagctgggatgagaatatgaactgcaggctcatgcagaaattcccggaaagcatgagttcaattcatatcgatgaaatcaaacatgcctccgtccgtgaagccgatatggagatatgttatgactatttaaaaaaggttgatatagagcattttgaatttatgaagagtctggggaaggtttatgcgtctgatcattctgtacttgcagagttgtcgctcagccaaattgccaaacaatataccggctattttcaattacatcccacttttcttgatgcgtctaccatcatatcgatcctttatcaggcatgccccgaatattttacacaaggatctccggcaagccggatgaaaacgtatattcccattcatattgaatctttccgtatgacgaagcgcctggaagacaggtgttatgtgtacatagagaagcaagaccaacatcatgattcaggggatgtcatccaagtcagttacggtttgtacgatgcacacggggagatgatcgcttattttacgcggctgtctgtgaaacatattcgctcaaaagatttaattgaaaacctgaagcagactcgtttggaaactgaagcggcttctcagccaaaagacggcctgatcagaaaagattccatcatagatcgaagcgaaagcattgagacacaccttaaagaattaatatccggggtttcaaatctagatctgcgtgacataaggacagacattggtttttatgaacaaggcctggattccgcttctttgcttgccattgtcaaagaacttgaaaacaaaacaggggaacagctgtatcctacactcctgtttgagcagaaaacgatccgggaactcgccgcgtatattaaagaaaatcaaaaaatgtccagttatttcttaacgcaaaatcaaccggctgaactgcctgacatgaaagaaagtaagaacgaaaatctttccgctcttataacagaaggaaacattcagcagctgatcgcagacatcaaagggactgcccctgaaacactctctgtggtaaaaggtttttatgaacaaggcctggattccgtcacacttatgcaagccgtaaaggcattggaggagaaaacaggcagggaactgtatcctactttattgtttgagtatccgacgattcaaaaacttgcaaattattttgcggagagcggcgaaaagacttccgttgaaaaagacctccctcttcatcatggagagaatcatacggctctgacctatttaacgccgtattggagacaaaaggctgccgcttgggacccgcattgcggaaataaaaagaaaagaacatgtctgctgtttcaatatgacagagagctttttcattttatgcgggaaaatgctgaaaatggattcgaaaatacacagatcattctcgttttatcagggaatcgtttctcctatcatagagacggtgtttatgagatagaccacagggaggaagctcactttgacaggcttgcagctgatctgaaaaaaagggggcaaatgcccgacaccgtggtttacgggtggccggaaggatcatttgccggcccggaaaaaataagtgaacagctttctaaaggggcttacccgctattctttttcagccgggcattgatgcgcagcaaggcggaaaaaaaggttgtatcgcttttcctttatccggcggatcataaaaatgatcagccgctttacgcttcagtccatggcgcagggcagtctattttgcttgagaacccgaaactggcccttaagacaatcgggatatcagtttcagacaagtcatcgttgccggctcttacagctgaaatcatcagatgcgaatcaactgaagcgcatccgggagaaaccgatctttattatgaaggaaatgtgcgctgggtccgtgccttacgggaagcagaaccggctcaaaactcaagtttctcctttaaagaaaacggagtatacatgattacaggaggggccggcggcttaggccttatatttgcagaacatatcgcagcgcaaacgaaagccaatattattttagcgggccgttctgaactgacggaagacaaaaagaacaaaatcaggcgaatgaaagcaggcggttcttcggttcaatatataagaggagatttttcagatagccgcgatgcagagcgaatcataaaaaccattaaaaggcaattcggagaaatcaacggtgtgatacacagtgccggtgtgacgcacgacgctttattgattcaaaaatcaaaagatgaaattcaggaagtgatcgctccgaaaataaatgggacggtcttattggacagcttgctgcaaaccgaacctttggacttctttgtgatgttttcatcaagcagctcgatgtacgggaatatcggacagacggattacgcattggccaataggttcatcgatcttttcgctgagtggcgtgaaggaatgaggcggaaaaaagaacgctccggcgtctcagtagccatcggctggcccctatgggaagacggcggcatgaaagtggataaacaaactgaaaaatggatgaaacaaaaaatcggtatggttcctcttagtaaaaccaatgggatcaaagcttttcaagattcactctctctgaacgcatcacagctgatcgtgtttgaaggtgacaaagaaaaattggaatctgcacttcaagataccttaatggaggatgaaagccgtgagatccaaataaatgaaacggctgatataaggcatcaagacattgccattatcggattaagcggaaagtatcccatggccgaagacttacctgaattttgggataatttaaagagcggaaaagattgtattacagaaatcccgcctgaccgctggaatatggatgatttcttcagcgaagacagagatatgaaagggaagtcttacagcaagtggggaggttttatcagcggtgccgatcaatttgatccgcttttctttcatatttccccacgggaagcagaacttatggatccccaggaaaggctctttttagaaacggccaaaaattgttttgaagactcagggtacccgagaaacatgctggaaaagatgaaagtcggtgtatttgtcggtgcaatgtggggccaatatcaactatttgaaggagaagaaaacggagtggctttctcgccggcttccgtctattcttcaattgccaatcgggtgtcttattactttcatttaaaaggtccgagtttggctctggatacaatgtgctcttcatcactaacctctattcattacgcatgccaaagcatacattgcggagagagcgatatggcattagcaggcggagtgaatttgtcaatacatccgaataaatataagttcctcagcatgggacagtttctatcaagtgacggcagatgccggagttttggaaaagacggaagcggttacgttcccggtgagggagtcggagccgtattgttaaaaccattgaaaaaagcaatagaagatcaagatcaaatatacggcgtgattaagggaagcgccgttaaccatggaggaaagacgagcgggtattccataccgaatccggatgcacaggcggaggtcatttcagaagcgcttcgtaaagctgacattgatccgaacaccgtcaattatattgaagcgcatggaacagggacgtcattaggcgatccgattgaaattcaaggactgaaagattcctatcaattgaaccatccttgcgccatcggttcggtgaaatcaaatatcggacatttagaatctgcggcaggaatcgctgcggtaacgaaagtgcttctccaaatgaagaataagcagcttgttccctctctgcattccgatattgttaatccgtttatagattttgatcaggttccttttcaagtgcagcggaaagcggctgaatggaatattccgcaaaacagccatgctgttcatcctttgagagccggggtaagcgcttttggggcaggaggaacaaacgcgcatcttatattggaagcgtatgagccgccaaaagcttttgatcatcaaagcggccgagtgatctttgttttatcggctcaagacaaacaacggctgataaaatatgcgaaggttatggctgattttctatcagaaaatgaatcgaaggataacaatcataaactgcgtcttcaggatattgcctatacacttcagacgggacgcgatcatatggaagaacggctggcgatagtggcagattccgggcaggtcattgctgaagagctttcagcttataccaggggtgaaaaaagcagcttaagctataccggtaatacattcgaatcagaagttcacaatgaaatgcctcacgtttgttcagattacgccgaagcagcatccaaatgggtaaacggaagaaagatagattgggagacttttgaggtgaatcggaatgcccgcaggatttctattccgggacaaccgctgatcaaacagcggtattggatagcggaaaaaggggaagcacttgtttcagcggatgtgagtaagacgggtcaccctttcttggggagtaacacgtccgattttaatcagttcagtttcacgaaaaaaatcagccgtaatcatccgttcgcactaagtctgtctgaaggaaacgtgtcctttttcccttacgcatccttggctgaaatggctatcgtcaatgcagcggcggcatttggacaaccagttcaaacattgaccgatttattgtggaccgaaagcatgaacgggatgactgatatacgggaactgatgattacgctgacgcctgagcgtgactttgcgcggtttgacatatatgcaaacacaaaaaatgagaataaagtacgtcttgccaggggaaatgcgcatatggttaagcctgaaagcggtatgcttcctgaagcgctagatattgctgaagtcaaatcagaaatgactgaacatccggctgaagcgccttttgtcatagaatcagtgaaaaacagttacggaatgctgtcgcttcattcaatgccggatgagctttatgcaaaaagagaaaattttacgatttcacctgaagcgcttgagtccgcgattcaagccagtgcgttttttgtcagcggagaaaccttcccggaattgatcggaatgggagcggcggatgtctatcagcctctcgctcaaaatttttacgtctatactcaaaaagagaaccggcagaacagccgtgatgtaacgtgtcatatgacatttacagatggaaacggaagcattctggcggagtgcagagatgtgagattcagatatggtcatgaaaaagacactgttcagacggacgatgaactcattcgtctcctgcgtcaattagaaaccaatgatattgatcagaaggctgtattgaaacaattaatgggggaagaatgatgaacggaaaacgtgaacaaatcagcgatattcttgatctgattcaaacaggacaaatgtcggctgacgaaggctatgcccgtgtgacatccattcagaatcaaaaatcacgggcatcgaaccatccgcttttatattacaagccggaatggactgaatcgttcattccgagtacgaagagcgtacccttgacgggattgctcctgatttttgcagaaaatgaacggcaaatacaagaattgagcggtttgtttaaggactgcactctcttgtttgtcatccgcggaaaagaatttactgttttacatgatgatacgatttgtatgaaccacgtgaaaaaagacgattatctaaagctgttccgatacattcatgatcattatcagacgcccgaaaagattcttcacttgtggtctgattctcaggctgacatgagtaagggaggtatacagaaacaattggaaaacggattgttttctcttctgtatattacacaggcgctgattgaactaaaatggaaaaagatactaaaactgacgcatgtttttcaaactgagaataaagaacaactgccgctgcatcatgctctcggcggattggtgaaaaccgttcaccaggaacaccccaattttcactatcagattatcaatatcactctttcagagggtgcgggagccgctcttccagcaatagctgatatatatcagagagagtgtgacgaaaaacgggatatccattttgaagtgcgctatgaaaacggcagacgttttacgaaaagctataataaagccggctcattcgatttaacccagccgctgaaacatcatgggaattatctgattacaggaggcctgggcggtctcggttatatactggcaaaacatctgtcggaaaaatggaaagcgaatctcatattgacagggcgctctgatttaactgaagagcagaaaaaaaagatcgaatatttaagaagctcaggttcaacaattgaatacatccgatctgatgtttcaaaacaaagtgatgctgaacggatgtttgcttttgcaaaagagcagttcggcaccttacatggagtatttcacagtgccggcgtactccgtgactcttttatcttaagaaagacaaaagaagaaatcgatcaagtcacaagttcgaaagtttatggcacgctctggctggcggaagaaatcaaaaaaatgaaagttgaattacttgtcttgttttcatccacatcggcagtcttcggatcagccggccaatgtgactatgctttcgccaatgcctttttggatcagtatgcagcagttatgaccgcaaaagagtctgccgaaagggtggtgtcagtcaattggccgctatggacttccggcggtatgaatattgacgatgaaggaatatcctacatgaaacaggaactcggccttgacccgttagatgacagtgacggaatacaggctctggagaacagcttgtgtcaatcatctgaacagctgattgccctgaaaggccgaaaagaaaagattgaggatgtgctgaagcgtgccggcacaatcagcttacattcataccagcaggaagatgccgatttacaaagcgatgaattaagacaaaatatcatcagttatctaaaaaatataatgtcagaggaattgaaattaccggcctcactcatagatgaaaaacaatacctggagaaatacggcattgattcagtgatgatcatgcgtctgaccaaaaagctggagcaaagtatcggcagattgtcgaaaacattattttttgaatatcattcaatatcgcagttagccgaatatttcctgagtcatcacagcgaacgaatgatgaaactgctgaacccggccggcaaatctgaacttgtttcatatcaaaaaaagcaaaaaagaaaaccggtggaaacaaaagcgccggcacgctctgaaggagaagattcaaaagagcactttgcggccgatcccctttctgctgatatagccattattggtgtcagcggcagatacccgggtgcggaaaacatcagagagttccagaatgtgctgatgaatggacgggattgcgtaagcgaaattcctgatgaccggaaggaaatgctcgagggaagctgctataagtggggaggttttctgaaaaatccagaccggtttgatcctttatttttccggatatcaccgaaagaagcggcttttcttgatcctcaggaacgtctctttttagagacagtgtacaataccatagaggatgcgggttataaaccttcagatctgacccgcaaaaaggtcggagtatttgcaggcgtcacatatggaagctatcaatttttcggcgttgaagaatcacttaaaggaaatgaactggccgtcgggtctccattttctgcaatagcaaacagaatatcgtatttctttaattttaaggggccgagtatggcggtggatacaatgtgttcatcctctcttaacgccattcacttagcctgtgaaagtatacggagaggggaaagcacacttgctgttgcgggcggggtcaatcttacacttcatccgaataaatatacattattaaatcaaagccgcttctttgcaagtgatggccgatgccgtacattcggcgagggcggtgacggttatgtaccgggagaaggagtgggctccgtacttttaaagccggcggcggaagcggtaagggacggagatcatatttatgcgctgattaaagcgacagcggtcaatcacggagggagaacaaacggttttacggttcctaatccaaatggtcagtctgaactgatacaggacgcgcttcagaaagcttgtattgaccctcgtacaattagttatattgaagctcacggaacgggaaccgcactgggagacccgattgagatcaccggattaacaaaagcgtttcgggaatttacggagcacactcaatattgttcaatcggttctgtcaaatcaaatatcggtcatcttgaggccgcagcgggaattgccggtttgacaaaggttcttttgcaaatgaaattgaaaaaactgtttccttccatacatgcggagacgttgaatccaaatattgattttaaagcatctcccttttatgtacagcggtcattgcaagactggaagaaaccgaaactgcaggaaaacggaaaaacagtaactgttccgagaagagcgggaatcagctcattcggagccggaggaacgaatgttcatatcattatagaagaatatgaagaaacaaacgtctcaacagaacatgttgagaacgaaccgcatattgtcctgttatctgctaaagacaatgaacgtcttcttgagtatgccgaaaacatgaaagattttattcagcgttcactaagtcctgaagtaaaggataaacagcctgatatgaaagaaaaggtgaatgaagtactcaaaccgtttgtttcggaattgcttcatatccatccagaagaaattaatatttctgatcacctgagtgaatttggcgtagggcctttggaattaagccggatggcggattttattaacgaaatgtttcatattgaactcacgatgtatgaattaacggattgtccctctattcaagcggttactgaatacttactgaaggaatatgccggagcgataagaaacatgttcccgaatgaagtgatggaaggcggccaatcggaaagcgtcgttttacgggatctggcatacactacacaatcgggcagagaagcgatggaggctagagcggcgattaccggtacctctcttaaagaaatgaaagataaattatctgagttttgccgcggtgacaagcaagttccaggcgtatatgttaatcagcaatcagatgcatttgctgaaaaaatgaaggcgttaacggaaggcagagcaggtgaattgtttgtaaagaccattattgagaacggtgaagcggaaaagctggctcaattatgggtttggggggcggatatcgactggaaatccgttcatcaacatttacagcagccgggtaaacggatctcaattccgacttatccgtttgcaaaagaacgttattgggttccgtccaggactgagaggacagagatccctcagcattcttttcaacatcacttgcaaaaaaaatggagggagaatccgtttgtaaatccttccgaaacaaaagagtacggactgacagttgtatttgtgaatcaagacacagaatcaattgcccgcaccatttgttcggatatagatcaggagaatctgattgtcataaaacatcactcttcatttataaaacactctgatcaaatgtttgagtgttctttattagatgaaaaccacgcatacgacgttatccgtgagatcttctcgggcggtgagcggcaggtcgaaaatatatttgatttctcagatatcggaaaccagagtgacaatcagaacggcatcccatatggtaaattcttatttatacaagaaataattaagcggagtaaaaaggaaacaccattatccattttacaaatcaccaatggcttgcaggtatttaaagcggaaaaaccaaagctgacgggtgcagaatcagcggcttttctgaaagccctttctgcggaatacggctttgttcatgtgaaaacaatagatatagacagcatgaaagaaacgcataagcttaaacaaatctttgagattgaaagggcgcaatgtaccggagagaatgaagtatgctaccgcagcggcgtcaggtatgttccgtattttgaagaagaaagaatccataccggcgggccggtttcatttcctgcggataaagccatcatcattaccggcgggacagggggcattggcagagcaatagctgaagatttggtgaaacggggagtgaaaaaactcgtgctgacgggtacgcgtccattacctttgcgaagtgaatgggatcatttgctgaaagagggcagacaggacgaaaagacagtcagcaatataaaactgtttcaaagttttgaagagaaaggtgtcgactatctgtattacagcggttctctcacaaatgaagagaagcttcgttcattctttcaccaagtaagccttgaatttaaagatattagcggtgtcatacactgtgcaggactgcacagcggcggaaatccggcctttattcataaaagaatgagtgaatttaagacggtgtacgggccgaaagtcactggacttcagaatttggagcggatttttaataataggccgctggatttctttattctgttttcatcaattgcagcacagtcacccaaactgtcgaaaggaatgactgattacgcgtctgcaaacgcatatatggactatttcgcggcttatcattttcaaaaggggagaacgtatttcacgtccatcaattggccgagctggaaagaagtcggaatggggactgtgacgagtcctttatatgatgaattgggattggactctctttccacgcgggaaggactggcgattttgtatcatgcactggagaaaaaatcggccaatatcattcctatcgtgaaaaaaggaacagtgtttcatgcagacagtctcctgaacatcaataaaaccggcaaggcttcatttccagcccgaagacaggagactcccggcacttttgatcgttcagaagggcttgtcagtgaactttctgccatatttgccgaggaattgagcataccccttgaaaagcttaacccaaatacggattttcaggaatacggtgtggattctatacttcttgtcagcattatacatcgtatagaagcaatgattcagaaaaaaatcgaccctactgtgcttcttgaacacaacacgattcatggtcttgcggaatatatcggtaagacggcgccgccgttgaaaaaacaaatcgaacagactgattctcaaagcagcaatcagcatgatatgcagtctgtgacgagccgagatacagaaccgcagacgccttcctctgcaaagatagctgttatcggaatcggatgtaagtttccgggcgcggctgataaagaggaattttgggacaatctgagaaaagggaagaatcatattaaagaagtacctgattcccggtggaatatagaagaaaattactctccggtgcagcaaaagggaaaaagcatcagcaaatggggaggatttatcaatggaatcggcagcttcgatccggagtatttccgcatggaagaggagaaagccatccaaacggacccgctgataagacatttcttggaaacgagtgtacagactgtacgggatgccggttatgaagaaacagaattatcgggaaaaaaagtcggcgtatttgtcggttccagaatgggcggctacggtcacaaactgccgaaagaaagcagcagccacatcgtcgggcttagtcaaaactttattgcttcacatgtgtcgcatttctttaattttcacggtccaagcatggtttctgataccgcttgttcttcttcattagtcagcattcatttagcctgccaaagcataaaaaacggtgattcagaaatggcgctggcaggaggggcggatctgcttttggatgaaattccttacctgatgttaacagaaggaggagctctttcgccggacggtcagtgttttacttttgatgaaagggcaaacggctttgtacccggagagggttttggcgctgttctgttaaaaccgctggagaaagcaaaagctgacggagatcggatatacggtatcattgaagcatcagctattaataacgacggtgcgacaatgggaattacgactccgaatcctaagcttcaagagcaggttattcaagatgcatttgaaaaagccgatatcactcccggatcagtcagctacgtcgaaactcacggcacaggcacgatgattggagatccgattgagcttcaggctctgacaaaagtattccgaagagacacaaacaaaacgcaattttgcggagtaggaagtgtaaaaaccaatatcggacacttattaagcgctgccggagcggcaagtttcattaaagtgattttatcaatatggcataaggaaattccgcctacattgaattgtgaaacgccaaatccccgctttgaatttgaaaagtcgcctttttatccgaatacagaactgagaagctggaaggatggaaaacggagagcgggcatcagcgctttcggttttggcggaacaaacgcccaccttttggtaagcggcctggatgattcatatcattccgtcagaactccgctgccgcctgccgagtttgtcagaaaagagtactggccggattcaaatcggaaaaaacaaatcaaacagaataaaaaacggcttcttgaaattattgatgaaacagagtagcacctgctctgtttctttactttgtaaaagaagaaaggttgtcgagttgcatgaggttcagcgtattagtcaaacatgacgattatattgtttcagaccatgtccttcatcaagtgcgtacgatacccggcgtaacgtatctggatttaataacacgatttttagctgataaagggatatcaccccgaagttttgaaatcaaacatgttttattccgtgaacctgttgccacgtcagtccattttgataaaaaagtcaccttccagtttatggaacaagaaaacggctggcttgttgaaacaacaagcaggaaatgggtcgctgaaaaggcggaaggtgaagcgtcagtcaacttgcaggcggaaatcataagaaaaaatgcgataaacgaaaagacaatttcaatcgaagcattaaagaaaggggccgtccggacttcggatgctgaagccgcctatcgtaatttgcgcaggggcggcctgattcataaagattttatgaaattggaaggtacggtatatgaaggtgaaaattatattctgggagaggtcagtttaagcggactttcaaaagaatatacagatgacttttacatgcatcccgcatttttggatggatctctcagcctgttgggaatccttacatcagacttgccggatgaaggaacaaatgcgtttatccctatatatattgagacattccgggcactgcataaaacaaccggatcttgttttgtgtatattaataaaaacagtataacgcagccgccttctaaagacattttatatgcggacatagaagtatacaggcctgatggagagcttgctttttattatgaacgattcggtgtgaaaagagtcagaaatgaaaaatcaatacaaaggctggagcattcccataaagcaaaagaggtcggcagcgtaacgagcaataaagaaatgatcagaaataatttgatccaagagatagccggcatgattgaaaagcctgctgaaacggtgaagaatgatatttccttttacgagatgggcttggattctaaacagttattagacttatccaaaaaattagaactgatgttaggttcaaagctgtacccgactttattatttgattactccacaatcggtgaattgacagaatatctgcaggagaaatacggagctcgcgttacagactctatctctgatacagttcagcaccaagacagtcaaaaaacattaacagatgagctgtcatccattattggagatgttacaaacacgccgccaaataaagcggacaaacatcaatctttttacgaactgggtcttgactcaaaacagctgcttcatatatcgaaaatgctcgaggaaagattagatacacaactgtatccgacattgctttttgattataacaatattcatgatttagcagcttatttagaagaaaaatatgctgtgcgtaatacgccggccgcagcttttaaagaaaaaacgcaaacgaaagagccgtctgaaaagccgatgcttgaatctttatatttacaaaaagaatggatagaatcgccattaaaatccggagaagtgtctaaggaaaatacattgattttcgatttcgacagttcattgagtgatgaaatccgaaagtacatcggcagtgaaaatgttatttatgcggaagccgctgctgaatatgaaatggtaaatgaaaagcattataaatttaatccggagcagtctgctcattacaccagactgttagatgatatgaaaaagtccggagcgtttccggcgtcaatcattcattacctgtcaaaaaaagcttatactgaggcagcgttagatttgactcacagcttttattcaatcctttatttaagcaaagcgttgatccgtcaaaaaataaaagataacatcaacattttgtacgtacatgacaaggatcaatatacaaatccggtttacgccgcgattggaggcttttttaaaacgctgaatgcggagcagccgaatataaagtgtaaaacggttgagatttcttcaagacagaccattgaaaaagcacctttgcttctcactgaattaagcgccggacatcatgaggctgtgaaatatgacggcgatcaaaaaaggcgggtgacagcatacaaagatgcttcgctgcaatcagggcaaaaggccgcaaagtttgtaaaaaacggagtgtatctcataatcggagggttaagcggcatcggctggattatttcagcgtttatttatgcaaatcacggagccagcgttatcattgccggacgatcgaaaatgacagcagaaatggaagaaaaattagacagcatccgatatgacggggcaagcatttcttacatccaggctgacatgtcagataaacagcaggtcatcaagttagcggaaaaaattcatgctgattattccgaaatcaacggggtcatttacagtgcaggcgtgttaaaagactctttcattatgaataaaacagacgcggaagctcaggcggtgctgcaatcaaaggtcaatggtgtgattcatttggatgaagcgctcagaaatatgcctttagacttttttgttttgttttcttccatctcatcagaaatcggaagtctgggtcaagccgattacgcctacgccaatcgttttctggagcattttgccgagtggagggaatgtatgagaaaggagggggggagatcaggaaaaaccatcgctgtaaattggcctttctggaaggacggaggcatgtcagttgatcccggcattcaagacattatgaaaaccgagtacggacttcacccattagaaaatactgccggaatcaaagcttttgaacactcgcttctcggccaaggccaccagctgatcgtgttatacggagaaaaagaaaaaatacaaaatgatttcaatccgttatccgcccgttcagcaccgcctctagtaagagattcagcgattgcagccgattttgatgcttcgtcaatcgttacggaagaagaagctgaaagtccattccgaatactcggcacagcttccaatcgtcatctcgacgattatttgcattattggagcagactgaagaaaggagcccttcagcacgatcaaagcgatgccgcaaaaaaactcatcgctttttaccagacagaagaaacggaaaccgttcattttctggcaaacacagaaaatgcccggcatatggaaatattgatgagcggtaagggtgaaacaattttactgatttgcggttttgctaccactgcttacatgtggaaagaacagatgaaggagtgggcagaccaatttaatgtaattgtcatccacacaccgggttacgggctgagtgaggggagcgccgattttacattgagcgggctggctcagacttttatcgaagtgctgaacgagataggggttgcttggccgatccacattgcggcagcttcttggggaggcatgatagggcagaggatagcctatgaataccctgaaaaagtaaaaacactcattctttccggaagttacaccgaatacgaagaagaccctgaaagcagtgttgaggaaaaactgaaaaatgattttatagctataggaaaatcgcatgaatatgaaagtttatacaggaatcaattcttaaatgcttctattgaacgttttatgaagatacatcaacaagaaggctattctacgatcggctttttaaaagacattcatacaagaacgcttatccttacgggtgagaaggaaagcgtagttgatcagaaagaaacaaaaaggctgcagaaactgctgagcaatgcagaattaaagaaaattaagggagcggggcatcttccgaacttcacacatccggaagaatttaataaagcggtgtcagaattcatcaagaaatcagtaagtaagggatgaaaacgatacatacagtacagggggagaaaacaatgaaacaaacaataagcaatccggcatttgatatgaaacaaattaacgctcttaacagccattatcagacgatgatagacaatggagatctgcaatgtgcgagttatatgatgtcaagaggaggcgaggtttttgcagctgagtcgttaggggaatttaccggcggacaaaaagaaaagcaaacatttcagcttgatacaatcagagaaatcggttctttgacaaaagtgtttaccgctgtagccgtcatgcagctcgtcgaaaaaggtctgctcgatctgaaaatgccggtcaagctcattttgcctgcgtttgataaaccgggtttcggagacattaaaattttacaccttttgactcatacggcgggattaagttttgagctggatattcaaaaggctgaagcgattgacttaacgaatgaggaagaatggataaactatctgatcagtacgcctttagagtacggagtggatgaagcatggaactattccagaaccggctttgttatacttggcatcattatttcaaaagtaacaggcgtatcctacgaacagtatgtgacaaagcatattattgaagcgctcggattagaaagaacgtttttttatgtgcctgatgcgttaaaagaagaagtttgtgtgatcaatgaacacgagtgcgtacagctggaaaaaagtcatcacccgtattttccgaataaagcgacaagcggtctgtactcttcgctggaagatatttggaagttagctgaaatgtttagaaataaaggcagattgaaagataagaagctgcttggaagaaaaacagtcgaggccatgctgagaaatcaaataaagcccggtcttcctttttacttcttcggagcgcccagagaggaaggcggctttggtttaggcattaatttgtggccggccggtgaccattatttcatgacagaaggcaccttctcacatcttggaatgggttggtgcggcatgttttctgatccagccgaagattttacgtatgtatttttcactccgatttccgagtttcatcctcatgccgtgctgacgccgctgaatatcgtgtgggcgggtattgaataattagacaaaagcatcgtcccgtctgtccggcaggcgggacgattgctaactgcccgtttttatcccgcggcatcttctcaaagcccgccctcgaagttaaataacttaatttactctttgtaattttttttaattatagtacagtagagcctttttataatacagtttaaagtcttttatagtacagtttggcgcagtatgatcttaagttttataagcggtttcaaaataaggttataaataattgacggctttgtttaattactgtaaactatggttgttgatcatattgtactaataaaaaatctttttttattagtacagtttaaacgtcattatctttgcttaagcgctatgtgaatttctgaatgattatttttagaattgcagagcatgataagactgtttttaatacggatggctaaacggtatcctaaccctgttaaatcaaaagaagaggtggtttaaaaaatggctgcaaagacaaaaacttcaattgttgatagcaaaaaacaatttgatgctattaataagcagtttgaaacgttccaaattttaaatgctgaaggagaagtcgtaaataaagacgcaatgcctgatctttcagatgatcagttaaaagaattaatgagaagaatggtgtatatccgcattttagaccagcgttcaatttctctttcccgtcaaggacgtttaggtttctatgcaccgacagcgggccaggaagcttctcaaattgcatcacacttcgcgcttgaacaggacgactttatccttccgggttatcgtgacgttcctcagctgatttggcacgggcttcctttacatcaggcattccttttctcaagaggccattttaaaggtaatcagatgcctgagggagtaaatgctttatcacctcaaattattattggtgctcaaattattcaaaccgcaggtgtagctttaggtcttaaaaagcgcggtaaaaaagcggttgctattacttacactggtgacggcggagcttctcaaggtgacttctatgaaggaatgaactttgccggagcatttaaagcgccagcgatcttcgttgttcagaataaccgctatgcgatttcaactcctgtagaaaagcaatcatccgcgcagacaattgcccaaaaagcagttgccgtcggtattacaggtgttcaagtagacggaatggacgcactagccgtttacgctgcaaccgcagaagcacgccagcgcgcaattaacggtgaaggtccgactctgattgaaactcttacattccgttacggacctcatacaatgtccggtgacgatccgactaaataccgtacgaaagaaatagaaaatgaatgggagcaaaaagacccgctcgtacgtttccgcaagttcttggaaaacaaaggactatggtctgaagaagaagagaacaaagtgattgaacaggccaaagaagaaatcaaacaagctatcaaaaaggctgacggcgaatcaaaaccgaaagtaacagagctgattgagaatatgtttgaagagccgacgttcaacttgaaagaacaacttgaaatttacaaagcgaaggagtcgaagtaagccatggcgcaaatgacaatgattcaagcgatcactgatgcgttacgcacagaactgaaaaacaatgaaaacgttctgcttttcggggaagatgtaggcgttgccggaggcgtattccgtgcaactgaaggccttcaaaaagaattcggtgaggaccgcgtatttgacacgccgcttgctgaatccggtatcggcggtctcgctctcggtttaggcctgcaagattaccgtcctgttatggaaatccaattcttcggattcgtatatgaagtaatggattcaatctcaggacaaatggctcgtctccgctaccgttccggcggacgctggacttctccggtgacaatccgttctccattcggcggaggggttcatacacctgaacttcacgctgacagtttggaaggccttatcgctcagcagccgggtattaaagttgttatcccttccactccttacgatgcaaaaggactgctgattgcctctatcagagacaatgatccggttgttttcttagagcatatgaaactttaccgttctttccgtcaggaagttcctgaggaggaatacacaatcgagcttggcaaagctgatgtgaaacgcgaaggtactgacctttctatcatcacatacggcgcgatggttcatgagtcgcttaaggctgctgaagagcttgaaaaagaaggcgtttctgctgaagttatcgaccttcgcactgtaagcccgcttgatattgatacgattattgcttctgttgaaaaaacaggccgcgcaattgtcgtgcaggaagctcaaaaacaagccggcatcgctgccaacgttgtagctgaaatcaatgaccgcgcgattctgagcctggaagctccggttctgcgtgttgcggcgcctgatacagtatttcctttctcgcttgctgagagcgtatggcttccaaaccataaagacgttcttgaaactgcgaaaaaagttcttgaattttaatcaggcatcataaaagacggtaaagagagtccttttctcttatgatgaaggagtctgtttactaggttcaatgcttgcgtatgcataactaaaatttgcttaatcaactaggaggtcgaaaactgtggcatttgaatttaaacttccggatatcggggaaggtatccacgaaggcgaaatcgtaaaatggtttgttaagccgaacgacgaggtagaagaagacgatgttctggctgaagtgcaaaatgataaagcagtggtagaaattccttcacctgttaaaggaaaagtattagaattaaaagttgaagagggaacagttgcaactgttggacaaacgattattacgtttgacgcacctggttacgaagatcttcaattcaaaggaagccatgattcaggagaggcgaaaactgaggctcaagttcagtcgtctgctgaagcagggcaggatatctctaaagaagagactcctaaagagcctgcaaaagaaaccggcgcaggacagcaggaccaagtggaagctgatccgaacaaacgcgtgatcgcgatgccttccgtacgcaaatatgcccgtgaaaaaggcgtggatatccgtaaagtaacaggttcaggcaataacggacgtgttgtaaaagaagatatcgacagctttgcaaatggaggagcggctcaagaagcggcaccgcaagaaacagctgcacctcaggaaacagttaaacctgcagcggctcaggctcctgaaggcgaattccctgaaacacgcgaaaaaatgagcggtatccgtaaagcgatcgcgaaagcaatggtgaactctaagcatactgcaccgcacgtaactcttatggatgaagttgacgtaacaaatcttgttgctcaccgcaaacagttcaaacaagttgctgctgatcaaggcatcaagctgacttatctgccttacgtcgtcaaagcattaacatccgctttgaaaaaattccctgttttaaacacatcgattgatgataaaacagatgaagtgatccaaaaacattacttcaacatcggaattgcagcggataccgaaaaaggcctgcttgtgccggtagtgaaaaatgccgaccgtaaagccgttttcgaaatctctgatgaaatcaacagccttgctacaaaagcgcgtgaaggcaagcttgcacctgcggaaatgaaaggcgcttcttgcacgatcacaaatatcggttctgccggaggccaatggttcacaccggttatcaaccacccagaggttgcgattctcggtatcggccgtattgctgaaaaagcgatcgtccgtgacggtgaaattgtagctgctcctgtcttagctctttctctcagctttgaccaccgtatgattgacggagcaactgcacaaaatgcgttaaaccacatcaagcgtttactgaacgatccacaacttattttaatggaggcgtaatgttatggtagtaggagatttccctattgaaacagatactcttgtgattggtgcgggacccggcggctatgtagctgccatccgcgctgctcagcttggacaaaaagtaacagtcgttgaaaaagcaacgcttggaggcgtttgtctgaacgtcggctgtattccttcaaaagcgctcatcaatgcaggccatcgttacgagaatgcaaaacattcagatgacatgggaatcactgctgagaacgtaacggttgactttacaaaagtccaagaatggaaagcttctgttgtaaataagcttaccggcggtgttgcaggtcttttaaaaggaaataaagtggacgttgtaaaaggggaagcttatttcgtagacagcaactctgtccgcgtaatggatgagaactctgcgcaaacatacacatttaaaaacgcaatcattgctaccggttctcgccctatcgaattgccaaacttcaaatatagcgaacgcgttctgaactctacaggcgcacttgcgcttaaagaaattccgaaaaagcttgttgttatcggcggcggttatatcggtactgagcttggaacagcgtatgcgaacttcggaactgaattggttattttagaaggcggagatgaaattcttcctggcttcgaaaaacaaatgagttcccttgttacccgcagactgaagaaaaaaggcaacgttgaaatccatacaagcgccatggctaaaggcgttgaggaaagacctgacggcgtaacagttacattcgaagtaaaaggcgaagaaaaaacggttgatgctgattacgtattaatcactgtcggacgccgtccgaacactgatgagctcggccttgagcaagtcggtatcgaaatgactgaccgcggtgtcattaaaacagacaagcagtgccgcacaaacgtaccgaacatttacgcaatcggtgacatcattgacggacctccattggctcacaaagcgtcttacgaaggtaaaatcgctgcggaagctatttcaggagagccggctgaaatcgattacctcggtattccggcggttgtattctctgagcctgaactggcttctgtcggttacactgaagcacaggcgaaagaagaaggcattgaagtcgttgcagctaagttcccgtttgcagcaaacggacgtgcgctgtctcttaacgaaactgacggcttcatgaagctgatcacccgtaaagaagacggtcttgtaatcggtgcgcaaattgccggcgcaagcgcttctgacatgatttctgaattgagcctggcgatcgaaggcgggatgactgctgaagatatcgcaatgacaattcacgctcacccgacattgggcgaaatcactatggaagctgccgaagtagcaatcggaagcccgatccacatcgtaaaataatgatgtaacaaagaaacagcccccgtttgtaaaagcgggggctgtttttattgtgcaagcacatgctgcataggtttgatgatatcctcttttttctttacggatccctcaatcttcatgaccacatgccgatgattgatcaccatcagcgcagggaacgtgttgatttcctcttcccatccctttctgttgtcataaaccttcatttgatcgacatgatggggatatttcttttctaaatcaagaatcgcatcgtaataaggaacttctttatctatatgattttcatcggaaaaaaacaagatttgagtgtgatgaatgctgtcgatccggttatttttgaatggaatgacagtagaaaccgaacagcttgacagaacgaacagcatcaaaaaaaagggaatcaccgtacggtagcgcatctatcttactcctctgttttatataatatattggttcatccatttataaggactatatcaagtgtatcacgagaggtgaaaaacctaaggcttgttactgaattgttatataattgaaaccgtttttaatgaagaaataatacgtgtgacaacttgcacagccgatgtgtaaaaaaggcacattgtttttcgtgagagcgctgttttttcgttatactgggggcaaaaccatatcaggagggattgtcatgtataaagccgctgcagccgtcatatgtatgtgcttactcgccggctgccaatcaaatgaaaagatgcaaacaaacaaaccctattctcaagccgcggccaatcatgccaaacgggaaaaccatcataaaaaagagaaaaaacagaaggcggagccccgttactatatcaatccgaaaaccttttctgtggaaaaaatggatgaacagaaagaaaaaaaaccgatcgcattggtaacgatcgatgacgcgcctgatcagcatgccgctgagattgcggacaaactgcatgatcttaatgcgtcagcgatcttttttgtaaacggacattttttgaaaaaagatgaaaataagaaagcgcttaagcatattcatgagttaggctttatgatcggaaatcatacaatgactcatcaaaacttaaaagatctttccgaacaaaaacaacgggaagaaatcattggcgtcaataaagcggttgaaaaggtaataggagagaaacccgcatttttcagggcgcctttcggaagcaatacggactacagtgacagacttataaaaaaagaaggaatggtgaaaatgaactggaccttcgggtatgattgggatcagaaatatcaatccaaaaaagcgcttaccgatatcaccctgagcagtccttacctgcgggacggcgccaacatattgatgcatgaccggaaatggacggctgaagccatgccggacattgtaaaaggattgcgtcataaaggatataccgtgattgaccctcgagctataaaaagaccgtaaaaaataaatgtgttatacaatttatcagttgacatattaaatgtgacataataatataataacaacaagtgaaaattaagcgttttcaaattctgagaaatggggaatgacagatgggtacaattgtttgccaagactgtaacgaagcgattcattactttgaggatgagaaggtcacgacgttatacggaacatgctgcggacaatgccagtgtcatcttgaagaagagtaaaaagcgtaaaaaggcccgaaacgatttcgtttcgggcttatttatgtttattggatggctttttgctctttgatgactctgatcatttcaagcgttgcatcttcgggaccctgcacaggaaggccggcgtccaagtttttaaaaatgtagctgatattttcttcagtaatgatctcacccggaataaagatcggaattcccggcgggtacaccatgacaaactctgcaatgatccgtcccgcggattctgttaacggaatgacttccgtatttgcgtaaaaagcgtctcttggcgtcatcgctaacagaggaatctcaggaagcagaacttccgcttgctgatgagcatagtcatttgcagaagcctgctttgaaatgtctgtaagcgcgcttacaagacggtcggcatctcctgctctgtctccgggggtgaaaatacataaaatattatacaaatcggacagctcgacttcgatattaaatgattcgcggagccatttttcaacgtcatgacccgtcaggccgaggtttttgaccgaaatgattaatttagtcggatcataactgaaggcagcttttgacccagtgatttcttcgccgacacagcggatgccttcaatttgattgaggcgttcccgtgtctgatccgccagcagaatcgtttcttcaagaagatcgcggccttctgtagcgaggcgttttcttgcgacatccagtgaagcgagaagcagataggatgttgacgttgtcgtcagcatgcttaaaatcgactgtactctttctttggaaacaaggccttctctcacatttaaaatggagctctgcgtcagggagcctcccaatttgtgcacgcttgtggctgccatatcagcgcccgcctgcatggcggacagaggaagcttatcatgaaaatgaatatgcacgccgtgcgcttcatcgacaagaacaggcacatcgaaagaatgcgcgagctttacaatgctgctcaagtcagctgccacaccgaagtatgtcggattgatgacaagcaggccttttgcgtcagggtgttccgtcaaagcccgctcggcggactcaagcgtaatgccgtgagaaattccgagctcatcgtcaatttccgggtgtataaaaatcggcaccgctccggaaaatacaatggccgacataatggatttatgaacgtttctcggaatgatgattttatctccgggtccgcatacggccatgaccatcgtcataatggcgccgctcgtcccttgtacggaaaagaaggtatggtctgcgccgaatgcttccgcggccagatcctgggcttctttaatgatgccctttggcgcatgtaaatcatccagaggttcgatattaattaaatctatgcttaacgcgttttctccgataaattgtctgaattccgggtccattcccgcgccttttttatggcccggaatgtggaattggacaggctgtctgtccgcgtgctttttcagtccgctgtacaggggtgtttcatgttgcggcaattgttttcccacctttatcataatacctacggattagtttgtattacattcagttttattacccgttttttaaacgtaaaacaaatgaattatattatgaacttgaaagaaagtaaagaacaatttatgatctatggaagatgcttattttgagcatgatgataaaggagtgaagacatttggaatatcaatatccgatgaatgaggactggacgacagaggaggccgtggacgtcattgctttttttcagcaggtggaacacgcctatgaaaaaggagctgaccgagacagacttctgaatgcgtaccgccgctttaaagaaatcgttcccgggaaagcggaagaaaagaaaatctgcagccaatttgaagctgacagcacctattccccgtatcggactgtgaaacaggcgaaacaatcagatcaagcgattatcaaaatgtagacaaaagcgagccggcaatcggcccgctttttatgttatgagactttctgagtcattgtgtataaaaaggaaagcttcctaaaagcatcttcaatggtttgcaggaattcattgttgttcatgttgatcacgtcttctttttgcagctgaatgccgcataaaagctctgcttttttcactgtctgcaggcgttcaaataatgttttcagctgctcctgatccatgtcggactgcttgtacgcacctggcttcgtatgatccggcgaccatacaaaatgaccgggaatctgttttgtgatttcctcctgcttcgcttccagcaatctgccgtattcctcttttatcggagattcataaatgatggcaaaccatacaaacatatgggtgtcccataaaccgatctgaaagtgagggagtttcttatagccgcgtttgctgttggcaaaggcaacccagctgtcagccggcgggttgacagatcttctcgcgtgcttggcgacatgcgggaacatttcatctcctgtcaatgctgacaatgtcggtgcgaaatgctctcctaacaaggtcagcttcggacggacttgttcttttaacacctccatgcgcgggtctaaaccttctattgtaaatgtatcgaagtcttcttttgtaaaacgcatctgagtcatctttttcctccttatcgtaagtattcatattttaccacagccgccgccggccgcaaaaacattgagaacgtttgagacgagaggattggtggtaaaaaacgaataggtaaacacacaattttaagaatgttgttacagccgaatataagtttccatacgatataagaagtatcattaataaattggaaaaatgggatgcttttttaacaaatgatctctggaaggggcgaaagacaatgaggcaagtggtgaaggaaggattcagggaggaaaaaaataaccgtgtagctgtctggagactagaggttgattatgaattggcaaccctgtacgaggccatgcaaaaagagaatgaagatcaaatcgatctcagcaaaagaaaactggaacgtctcagaaaagaatggattcggcttaacggataaagaatagtaaaaacgaaccgcaggaaatggttcgtttttacgtgagaaggcatttttttcattttccttgctttttcatcgcctttatcagtatgctatagaataagctatacatagaaaagaggtacacggtatgacaaattggacggaaattgatgatatcgcaaaacaatgggtaaaagaagccggaacgagaatcagacaatccatgcaggaaagcttgacgattgaaacaaaatcaaatccgaatgatttagtcacaaatattgataaagagacggagcgctttttcattgaccgtatacaaggaacttttcccggacaccggattctcggagaagaagggcagggggataaactccgctcccttgacggaatcgtctggatcattgatccgattgacgggacgatgaattttgtccatcaaaagcggcatttcgcgatctccatcggcatctttgaagacggaaaaggcaaaatcggcttaatttatgatgtgatgcaggacgaactgtatcacgcattcagcggaaaaggggcttatctgaacgatgcgccgcttgctcctttaaaagaagcttccattgaagaagccattattgcaatcaatgccacatgggtgacggaaaacagaaggattgacccgagtattttggcgccgctcgtaaaacgggtcagaggaacgcgttcctacggttcggcggcacttgagctggccagtgttgcggccggccgcattgacgcatatattacgatgaggctcgcgccgtgggattacgctgccggctgcgtgctgctgaacgaagtcgggggcatttacacgaccacagacggcgaaccgttcacgtttttagacaaccacagcgtgcttgcgggcaatccggctatacataaaattatctttgacgactatttacatgctgacaggtagagattttgaagaagaagatctcgggtttctggagcagctggcggcatcgcacccggtgtggaaaaaggaagagttcggaacaaaaaatgcggcggagtttatgcttgcatactccatgtacaatggaacgtggctcgtatgggagattgacggcgctcctgccgccgtcagttttcatttggaatgggccccttcaaacggaaaaccgtggctcggaaccgtggccgtcgctccggaggcaaaagagaaaggaatcggacgcgcggtcattgaagagattgcgggccggctgagaggagagcataaagcgatgttttcagccgttcccctggacaggcaggaatgggttttgtttttaagtcaatgcggctttgaacagcttaagcttgaaaaagacgatcgggaaaagacatatatgatcatggtgaagccattgtgaaatgtttcagatataaaaaagagaccggatttctccggtctcttttcttgtttacaagccgaccgcattccaggccgcttctacgcttgcagcgtcttgagagccgtaaaggtcccgcgctgattgaatcaaagctgcttttgcatctttaaagcttgatgacggagtgagatataccgtcagtgcgcgatagtaaatctgctccgcttttttcacgccgatttttgtaatcgtgttgtaagcggctttgttcggaattccgctgtttgtatgcacgccgccgtagtcgccggcatcagtgttcggaaggttttgataatttttgtaatggtcgggctgtccgtattttgtcggattggataagctgcggagagccggctggctgaccgtaatatcctcaccgatatcccagtcctcagtatcggtgaagtacccgaatacatcggagaaggattcgtttaaagcgcccggctgattttcatagttcaggttggccgtttcctgtgtaacgccgtgtgtcatttcatgagccgtgacgtccattgaaccggaaagaggcgagaagaatgaaccgtcaccgtctccgtaaatcatttggtcgccgatccaggccgcgttattgtatttgctgccgtaatgaacggaagatacgattttgccgcctctattgtcgtagctgttgcgtttaaacgtctgatagaaataatcatacactttgccgagattgtaatgcgcatcaacggcagcgcgctgagaagaagttgtgaactggtttgtagtgcttgatacgagtgtgcccggcaggttatattgtcggttttgcagatcgtacgtaataatttgtgttccggtaggcttcgaaagatcgcgcattacatatttgccgttttcagaagaaatatttaatgagaccgtttttcctttaagagtcgtacctgttccggttgcagcggcatgctccactttgttttgctttttcaggactttccctgtttccgcatcaacggttacttcccagttagctggttccggttcgatgtagcggatggttacatcataggcgaggcggtatttaccgtcttttgtggccgctgctttcagctcggctttgtttttgtttgcaacgttgccgttagagacggcttcaggtgatttgccgattgctttaaaagcatgatccagcgcctgatttgcagataattttttgctgtttgccgttttggcagaagcatcgttgtttaattcgccgttaatcgcatagacattgttggatttatcgacgtgaataatgacttgcgagtccttcacaggcacaccgttaacgacaggcacataacggaagtgcttgtagccgagatcatcggtcgtgtggtcaatcagcttcagtctctcagaagggttgcctttgaagactttgccgttttgtttcaagtattgcttgattgctttgtcactgactgaaggcaattcagattgcaccaaagaatgcttcggcacaaagttcgtcaggttttctttaagctgaggattctcagcggcctgaacacccggaagactgatggttaaactcataaaggaagcggcgacagcaacagacaatttcttacctaaacccacaataaatccccctttttgaaaataatgaaaacttatattgttataataaaccagcattctctcattctgcaatataaaactagactccgctgatgaattgatagaatcgtcccgtaaaggcttccggcgggcagcgtcaggggataagccgagaggcacgtgttgaatcagacatgagtcgaatgatgcgatttattctgaaaaaaatgacaaatgaagtcgggaaaaatgatagaggaaaaatgttccgatctgtaaaactttttttatagccgtttgtctaaacaggtgaggccttaataaacgaaaaggattgtttcagatgtcagagattttcagtcattttattcagcatttcgacagatatttcaagagctgtcttacgaagagattgctgatgttttggactggagtctttcgaaggtgaagagcaccctgtacagggcgagaatgcagctgaaacagcacttggcggaaaaaaggaaggacggacagatatgatttgctgtttagtgagagatttactccctttatatattgaaggcgattgtgaaacagaaacggagcggtttatttcccgccaccttgaatcatgcggtaagtgcgaaagtttatatcatatgatgaaggagccgcttgacctcggcagccctgagatgaaggcgccagcctgttatgcagaagaagaaaggcggtttaaggaacggtattacgggaagctgctgataaaagcagccggtttgttcggggctgttttctttatcatgctgatccttaaactgctgatttaaaaaaacgcccggctgaatgaccgggcgttttatccgtttactcagccggatgaaaggctgtataaataccttcaagcaattcttggggcagtgaattaaagaatccggcacacagctttgcttctttttttcctgctcctgctttttcagcaaggtcctgatcaaacgtatacacaccgtcttcttcaatcagcgcagattgaaggatatgaagactttgggaaaaagcggtgaacagctgatcaacgataagagcttctttttccgtaaagccgagctccacagctttttctttattaaatgtatattcgccgtccgttttctcaatacattgggaaaggacggttaaaaattccgttgagctgtcccacagcttttgaatggtctgtgcggtttctttatctaatcccaattcaaccgcttttttactgtcaaaataatagatgccgtcttttttgtaaatcgattggccgatgatgtcaatgagttttgccgcgtcttccggtgttttctctgcggaagcctgcagggcatgtggttcatttgcctggatcgtttttgcgccggcagaatcaagcggactgaatgcaagcaaggcggctgaggcggttgcggcggcagttacagcggttttcttcaaaaaagatgttttcatttcattctctccttgtcatgtgtatttgcttacagtcacaagtataaaaagacaatgatggaattgatataggaggtatggtattttctgcataacgatgccggactatttcagactgtatattctgagggaatctgctgatgtaactagaatgggggccgtcattcccggcttcctgactagacggcgggggagataagccttacatctggagtctgtttttgaggaggtaaaaaagcctgaatctttgattcaggcttcataagatattgtctttccatgtttacggaattttgcaaagggtcatgcttttaatcaagcagtccctgttcgcgcatttttttctttacggtgaaaccgcttcccatcatggcgataacgagaacaatgcttccgatgataccccatgcgcttttctcagcgattgatacgccgatcagcatcatgctgaagactgctgcgaatgcaaataataataagagccaattcaattttttcatatttccatcccctttaacgtcatactttcagtttacagaaaaacgtaacgcttttaaagaggatgtgtggtataatatgaaagttatctaatttttttaggagatgaaaatgtgaaacttcgaaacgatcttcgcaacatcgcgattattgcccacgttgaccatgggaaaacgactttggtagaccaattgcttcaccaagccggaacattccgtgccaacgaaaatattgccgaacgcgcaatggattcaaacgatcttgaacgtgaacgcggtattacaattcttgcgaaaaatactgcgattaactataaagatacacgcattaatattttggacactccgggacacgccgacttcggcggagaggtagaacggattatgaaaatggttgacggcgttctgttagtcgttgacgcatatgaaggctgcatgccgcaaacccgtttcgtactgaaaaaagcccttgagcagaacttaaatccggttgtcgtcgtaaacaaaatcgaccgtgatttcgcccgcccggaagaagtcattgatgaagtgcttgatttgttcatcgagcttgacgcaaacgaagaacagcttgagttccctgtcgtctacgcttctgcgattaacggaacggcaagtctggatccgaaaaagcaggacgaaaacatggaatcactgtatgaaacgattcttgaacatgtccctgccccggtagataacgccgaagagcctcttcaattccaagtggcgctgcttgattacaatgattatgtcggccgtatcggtatcggacgcgttttccgcggcacgatgaaagtgggtcagcaggtttcattgatgaaacttgacggaacggttaaatcattccgtgtaacgaaaatcttcggtttccaaggattgaaacgcgtggaaattgaagaagcgagagcgggagaccttgttgccgtttcgggcatggaagacatcaacgtcggtgaaacggtttgtccggctgaccaccatgagccgctgccggttctgcgcattgatgagcctacgcttcaaatgacatttgtcgtaaacaacagcccgtttgcaggccgtgaaggcaaatatgtcacagcccgcaaaattgaagagcgtctgaatgcgcagcttcaaactgacgtcagtcttcgtgtcgaaccgactgcatcaccagacgcatgggttgtttcaggacgcggtgagcttcacctgtccattttaattgaaaacatgcgccgtgaaggctatgagcttcaagtgtctaaacctgaagttatcattaaggaaattgacggcgtcagctgcgagcctgttgagcgcgtgcagattgacgtgcctgaagagcatactggttctgttatggaatcaatgggtgcgagaaaaggcgaaatgcttgatatgattaataacggaaacggccaggtccgcctgatctttaccgtaccttcacgcggactcatcggctattctactgagtttctgtcactgacacgcggtttcggtatcctgaaccacacgtttgacagctatcagccgatgcaaaaaggccaagtcggaggccgacgtcagggtgtgctcgtttccatggaaaacggaaaagcgacatcttacggaattcaaggtattgaagaccgcggcgtcatcttcgttgagcccggaacagaagtgtatgaaggcatgattgtcggcgaacataaccgtgacaatgaccttgttgtcaatgtcagcaaaatgaaacagcagacaaacgtacgttccgctacgaaggatcaaacgactacgattaagaaagcgcgcattatgtcgcttgaagaatcactcgagtacttaaacgaggatgaatactgcgaagtaacgccggaatccatccgtttaagaaagaaaatcctgaataaaaacgaacgtgaaaaagcggcgaaaaagaaaaaaacagcaggaatgtcttaatcacttgcagaatttgaaaaggtagaacccgaacggaaaaggggagggggatctttttgaatgaagtaagtgaacggctgtcgttctttgcggctctttaccaagtggatgagcatccgctggcgggaatgtggctgttatacggaacgatcgtcgtgctttcggtgattgtatttaaactcggctttgccaaacggctgccggttttgaaggctgcggcagtttatctctttctcgtgctcggctgcaccgtgctgacttttttcggtgtgtttttgccggtcggagaagggcttgttgttgccgccttgattttgatcatttacaaaatccgtctgcaccagtccaaaaaaagccagtcagctaaaccgcaataaaaaatgaccttgccttccggcgggtcattttttattctgtttattttttcagtttatcttttttcgctttttgtccaggatgaaaggaaaagtgtccggtattcagccgcgcctccgttttgattttgattcggtcatggcattcccggcacatatatgtatgaatcggacgattgcggaggcgtttggctgtcagtgtttcatcatcaatttgttcgattttgtcgcaaatggaacattttactctcattgattttcacctctttcactatgacaagcattatatcatggatgcccctcctgccaaagggaaagaaagcagcgcccttcttttggagcgggcgctgctttttactggcggtttttcatatgatgatccgattgatcgttctgttcgttctgcagcttgttctggtctctttggttcagctgatcatcattcgattgagtcggtgattctttttcattgtcggtcacatcattcgggacttccggcatgacacgaccgacgatggcggcaagttcgtccaaaatgcctgaaacggggcggccggctttaatgtcgctgcccatgcctctcagacgggaaaccgtatcaggatcagccacgacaacggcattggcgccgtaaggatcgttttttaacgcctgggcaaccgtgtatttaatgctctccaccttgcttctttctaaattgtcatccacatcgattccgacaacggagtatcttccgagtactaccgcggtggcatctgaaatgccggggattttttcggttacctcgacgagatgcttagcgatgtctgtccggccgggattttcagctgtctcaggagccgtattttttacatgaatcggttttgcatcacgctgatcggttgattcgttctgaatattgcggccgcggccgtcctgtacagcagtgcagccggtcaggataaacaaggcttgtatgataatgaaaagaattcgcacgtcagattccctccttgaatgctttcatttattttattgttgaattaaccttctatctttattcaccaaatcatatattttagcaggcatccccgtttttcgcggaaagagaagcacacgatgggctttgatccttatttcaggaggctgagacttgagtaaaatttatgtgttagatacgaatgtacttttgcaggatcctaacgccattttttcctttgaagaaaacgaagttgtcatccccgccgtcgtgctggaagaggtcgattcaaaaaagcggtatatggacgaggtcgggagaaatgcgaggcacgtatctaagctgatagacgggctcagggagaaaggaaggctgcacgagaaagttccgcttgaaaacggaggaacgctcagaattgaactgaaccaccggtcatttcatcagctccaagaaatttttatcgaaaaaacgaatgataaccgcattttggcggtggcaaaaaatttaagccttgaggaggaaacgaaagaaaacggccgcctcgtcatcctggtcagcaaagatgtgcttgtcagggtaaaggcggatgccatcgggcttttggcggaggactttttaaacgacagagtcgttgaccatgatgaaatatatagcgggtacaaagatatatttatgaataaagagcggtttgcctcgttttataaaaacaaacaaattccagtcaaggagcttcagcagcatcaggtttatccgaatcaatttgtgctgatgaaagatgaattaggaggatcttcgtctgcggtcggcatggcggataagaaaggagagaccgtaaaaagactcgttttcgatgatgagcacgtatggggtatcaggccgaagaacgtccagcagacaatggcgctcgaactcctgctgagggaagatatcccgcttgtcaccctgatcggaaaagcgggaacgggaaaaaccttgcttgctctcgcggcagggcttctgcagacggaggatctcggtatttataaaaagctgatcgtcgcgcgtcccatcgtcccggtgggaaaggatatcggatatttgccgggcgaaaaagaggaaaagctcaagccgtggatgcagccgatctttgataatcttgaatttttattcaatgcgaaaaagccgggtgaacttgaagcgattttggcaggaatcggatcgattcaggtggaggcgctgacatacattcggggaagaagcattccggatcagtttattattattgatgaggctcagaatctgacgaggcacgaggtcaaaacgcttttgacaagggtgggagagggcagcaaaattgtcctgatgggcgatccggagcaaatagatcacccatacttagacagtttaaacaacggacttgcttatgttgtagagcggtttaaaggacaaaccgtctccggcagcgtgaagcttgtgaaaggtgagagatccggccttgcacagcttgccgccgatttgttataaaacttcgatttctgtgacgcccgttatcggtttttcaaagtctccgtccacgtaaaaatggaccgggccgccgtcttgaagcggtttccccgcatcgctgaaatgcgcgattgcgtccatcgccttttcaagcggcacttcgattctttctgattttgaaataaatgcgcacaggacagcgctttctttcggctcggcatttgctaaaacagcgccgagcttcatggcgaagctgccgttcatcagtctttctttttcataacgtttttcgctttttaaagtcggcggcgaaatgcgcccttctctgatcacccgttccggatcaagtgtatgctcctgggtttctgcagagccgtccggatgaacgggctgattgttttcaaacggaaacttgcggtcatcgaaaatccagacactcggatcaattgtaatcgggtatgtaacattgccttttacttgaataacgctcatgttgaagcccccctttacttaaagtataaaagttttcgcatgaattgtcactttgcgtcgcaaacttagatgtatacaacggcagcgaagtgaggatgatcgacatggtatgccggcattaccaagagctggacgcattagttcaggaagcgaaaaaaaggaccgaagaaggcaaagtggcagactatattccggctcttgctgaatccgaacaagacagcctttcggtcacgatttatcatgcggaaaatacatgtctgacggcaggagacgccgaccggacatttacgctgcagagcatttcgaaagtgctttctctggcgctcgtactgatggattacggaaaggaaaaggtgttcagctgcgtgggtcaggagccgaccggcgacccgtttaattccatgattaagcttgaaacagtgaatccgggcaagcctttaaatccgatgattaatgcgggagctctcatcgttacgggtttaattaaagggcattcgccgaaagaccgcctggattacctgctcggattcatcagaagacttgcgaacaatcaggacattacatattgcagacatgtcgcggaatcggaattcaaatcttccatgattaatcgggccatgtgttattacatgaagcagtatgacatttttaaaggcgatgttgaagaggtcatggatttgtatacaaaacagtgcgcgattaagatgagcagtctggatttagccaaaatcggctgtgtattcgcccttgacgggaagcatccggaaaccggggagcaggtcattaaaaaagatgtggcgagaatctgcaagacgtttatggtgacatgcggcatgtacaatgcgagcggggaattcgcaataaaggtcggcattcccgctaaaagcggcgtttcgggaggaatcatgggcatttcgccgtacaacttcggaatcggtatattcggcccggcgcttgatgaaaaaggcaacagcatcgcgggtgtgaagcttttggaaatcatgtctgagaaatacaggctgagtattttttgaaacattttttatcataacatctgcttaaatcctcttgcaatttcatctgataccctttatgataaatagaagaattaggtactcgcctggggaacggagggatacttttggcttcagagattatagttgaccatcagcagaaagcattcgagctgttgaagttagatgctgagaagattttgaagctgatccgagtacaaatggataacttaacgatgcctcaatgtcctctgtatgaagaggtcttggatactcagatgttcggactgtcgagggaaatcgattttgctgtccgcctgggattagttgacgaaaacgacggcaaagagctgctggacagacttgaaagagaactgtctgctttgcatgacgcgtttacaggaaaataaatgatcaaactcaaactattcaacggtttgggtttttttataaccgtaaaccgttttttttgcatcttcttttcgtaagacggtctcttaatctgcatttcatccgaaaaactataaagaaactgcgtaaattgtttatgaattatagtaaaatataatacgcaataggtattaaacgtaagctttaagcaggaaagaggatgttatgtttaaaagaatgttaaaatcttacgattattcattgatatgcgctatcattctgctgtgcagtttcgggttggtaatggtatacagctcaagcatgattaccgccgttatgcgttacggcgtgagcagcgactatttctttaaacggcagctgttcgccgtcatcgcggggtttgtgctgtttattatcgcggccgtttttccgtacaaagtgttcgcccatcaaaagattcagaaaatcatactgcttgcgtcagtggctgcgctttgcgcgctgtttgttttcggacatgttgccggaaatgcgcaaagctggtttaaaatcggcggaatggccattcagccgggggaatttgtcaagctgaccctgatactgtatcttgccgcagtgtacgcaaagaaacaaagctacatcgatcagcttttgacgggggttgcgccgccggtgatcgtcaccgtagtcatttgtgcgcttatcgctattcagcccgacttcggaacggcgatgattatcggtctgatcgcgttttgcgtcattatgtgttcgggattcagcggaaggaccctgctcaggctggttctcatggcgggaatcgtattactccttgtcagcccgatcatctatctgaaatgggacgatattttgacacccgggcgtatgagccggtttgaaagccttgaaaatccatttaaatacgccagcacatcaggcctgcagattataaattcgtattatgcaatcggctcaggcggttttttcggtctcggtcttggagaaagcattcaaaaatacggttatctgcctgaatcgcatacagactttattatggcggttatttcagaggagctcggcattttcggcgtcctgtttgtcattgtgctgctggcttttgtcgtgttaaaaggtttttatattgcgagaaaatgtgaagatccgttcggaagccttttggcaatcgggatatccagcatgattgcgattcagacctttatcaatctcggcggtgtcagcggtttaattccgatcacaggtgttccgctgccgtttatcagctacgggggatcatcaatgtttttgttattaacgagcgccggtatattggtgaatgtcagcatgcatgtcaagtactcagaaaagaagaaaaagagggagcccgttccgtctaagggggtaaaaagacggcagacggaaaaatctgtgtatctctaaaaaacaagtgtatacacagggcggatattcctttattataaactacatatttattaggccaagggggagaaaagtttgtcacaacaatccatccaaaaagtgttagtagcaaacaggggagaaattgcgatccggattttccgggcgtgcacagaattgaacatcagaacggtagccgtttattcaaaagaagattcgggctcctatcatcgctataaagcggatgaagcttatcttgtaggggaaggcaaaaaaccgattgacgcgtatcttgatattgaagggattattgagatcgcaaaaagaaacggcgttgatgccattcatccgggctacggatttctctctgaaaatatccaatttgcgagacgctgtgaagaagagggcatcgtatttatcggaccgacgtcagcgcatttggatatgttcggagataaggtaaaggcgagggagcaggcggaaaaagccggtatccccgttattccggggagtgacggaccggctgaaacaataaaagatgtcgaacaattcgcaaaagtccacggatttccgtttattattaaagcatcgctcggaggcggaggccgcggaatgagaatcgtccgaagcgaaagcgaattgaaagaatcgtttgagcgggccaaatcagaagcgaaagccgcattcggaaacgatgaagtgtatgttgaaaaactgatcgaaaatcctaagcatattgaagttcaggtgatcggagataaagaaggcaatgtcgtccatctgtatgagcgggactgttccgttcagagacgccatcaaaaggtcattgaggtggcgccgagtgtatctttgcagcctgaattaagggacgaaatctgtgaagcggctgtggcgcttgcgaaaaatgtcggctatatcaatgcggggaccgtggaatttctcgtagcgggcggtgaattttactttattgaagtgaacccgcgcgtacaagtggagcatacgattacggaaatgataacgggggttgatatcgttcagacgcagattctcgttgcgcagggccacggactgcacagccgtgccgtcaatatcccagagcagaaagacatttttacaaacgggtatgcgatacaatcacgtgtgaccactgaagatccgctgaatgactttatgcctgacacgggtaaaattatggcttaccgctcaggcggcggtttcggcgtccgccttgatacgggaaacagcttccagggcgccgtcatcacgccttattatgattcactgctcgtcaagctgtcgacatgggcgctgacgtttgaacaggcatcagcgaaaatggtccgcaacctgcaggaattcaggatcagaggcattaagaccaatattccgtttcttgaaaacgtggcaaagcatgaaaaatttctgacgggccaatacgacacatcgtttatcgacacaacgcctgagctgtttgttttcccaaaacagaaggaccgcggaacaaaaatgctttcctatatcggaaatgtcacggtgaacggttttccgggaatcgggaaaaaagaaaaacctgcatttgataagcctcagaccgttacgttagatatcggggaaaagccggcaagcggtacgaaacagatccttggtgaaagaggcgccgaggggcttgcagactgggtgaaagagcaaaaatccgtgctactgaccgatacaacgttcagggatgcccatcagtccctgctcgcaacacggatcagatccaatgatttgaaaaaaatcgcgaatcctacggctgccctgtggcctgaactgttcagccttgaaatgtggggaggcgcgacatttgatgtagcgtaccgtttcttaaaagaagacccttggaaacgccttgaagatctccgtaaggaagtgccgaacacattgttccagatgctccttcgttcatcaaatgccgtcggttatacaaactatcccgacaatgtcatccaaaaatttgtccggcagtcagcggagtccggtattgacgtattccggatctttgacagcctgaactgggtaaaagggatgacgctggcgatcgatgccgtccgtgaaaccggaaaagtggcggaggctgcgatttgttacacgggagatattcttgataagacccggacgaaatatgatttgcaatattatctttctatggcgaaagagcttgaggcgtctggtgcgcacattctcggcattaaagacatggccggtcttttgaaacctcaagccgcatacgaacttgtctcagcgctgaaggaaacgattgatattcccgttcatcttcacacgcatgatacgagcggcaatggcgtctttctctatgccaaagctgttgaagcgggtgtggacatcgtggatgtcgccgtcagctcaatggcgggtctgacttcacagccgagcgcaagcggattttatcatgcgcttgaaggaaacagccgccgtcctgaaatggatgtccggcaggtggaaagactgtcacaatattgggaatccgtccgtcagtattacagtgaatttgaaagcgggatgaagtctccgcatactgagatttataatcatgaaatgccgggcggccagtacagcaatctgcagcagcaggcaaaaggagtcggcctgggcgatcgctggaatgaggtgaaagacatgtacagcgtcgtcaaccgcatgttcggcgacgtcgtgaaagtaacaccttcttccaaagtcgtcggagatatggcgctttacatggtgcaaaacaatttaacagaacaagatgtttatgataaaggcgaaacgcttgattttccggattcagtcgttgagctctttaaagggcagatcggccagccgcacggcggatttccggaaaaactgcaaaagctcgttctgaaaggacagacgccgatcacggtaagaccgggggagctgcttgaaccggtatcttttgaaggcattaaagaagaatggaaagaaacgcatcagatggaattgagtgatcaggacgcaatcgcgtatgctctttatccgaaggtgtttactgaatatgttaaaacggctgaacgcttcggtgatatttccgtattggacacaccgactttcttctacggcatgacactcggtgaagaaatcgaagtggaaatcgagcgcggaaaaacgctgatcgtgaagcttgtatctatcggtgaaccgcagccagatgcaacacgtgtcgtttatttcgaattgaacggccagccgcgcgaggtggtcattaaagatgaaagcattaaatcgtccgtgcaggaaaaattaaaagcagatcggacaaacccaagccacattgcggcatctatgccgggaacagtcattaaattgttaacggaaaccggggcaaaggtgaataaaggcgatcatctgatgattaatgaagcgatgaaaatggagacgacggtacaggcgccgttctccgggacgatacagcagattcatgtgaaaaacggtgaaccgattcagacaggcgatttactgatcgaaattgaaaaagcgtaaaaaatgaacataaaaaacctgatccgccccgtgtgcgatcaggttttttatatgtaaaaaggccgaagctctgatgcttcggccttttcgtgtgcctcagatgttccgctgttttgattcatagcggaagcgggcgattaataataagaaatagcataagacgccgaacagaccggcaataaagagcgaatgggcaagtgcaaagccggtggccatttctgaataaacaaccatgattccggagagcgcctgtaatacaacaaaggcaagagccgctatccagcccccaagaatctgtttttggtctttgtaggagcgcaccgcatgcgcaaaagcgacaagaatccatacgaacagaagcagcgctgccgttctgtggcccatctgcacccactcctgaaaatgagacggaaacccgtggttcagcctgctgcaaagcggaacgtcaggacaggcaaggcttgatttcgtatggcggacgtaagcccccgtataaacgacgatatacgtgtaaatcgaaaggccgatcatatgaaactgcattttcctgccgattctgagcggcttgacgagctttttgtctgatttatcagcttcaaatatgagcagcgtcaaaatcagaacagaagcgaaagaaatcagcgatatgccgaaatgaagcgccataacgagcgcatttgatccgaaaacaaccgctaatgcgccgagaagcgcctgtaaaaataaaaagataatggacataatggcgagaaaggttgtttcacggaaaacaggcgtgacttttctccatgcccaaaaagcgagactcagcacgagaacgattgagacaccgcttgcgagtctgtggctccattcaatgatagaagcggcgttaagctccgggaaaaaccggccgtggcaaagcggccactgccttccgcatccgagacccgatcctgtttttgtgacaagagcgccgccgatcagcacgacgagcataacgaacgtcgtcagcacaccgagcgctttcaaagctttattcattttacattcaccttcttaacaaactggacaaaatgatatacgtaccaagtgtaagcgaatatgtgttttgtggcaattctcaattctgtttgttcacaaaaatataatagaatcaggacttcttagataatggggttgattattccagatgggtctgatagaaataaagtaaccgctttattatgaaaccggcggatttggtaaaattcataaaaagttcacaaataaattcctgtttctcgtttaatatttaagaggatgtttttttacaggtcattatcttgtatgatagagttgcaggtcttaaaaaacctgctttaggtttgtaagggaggtttacgttatggctaattccagaattttaaacgatacagctatagacggacagattgaagagacgacggcatggaaggatttcctttcgcttatcaaaataggaatcgtcaattcgaatttaattacgacttttaccggcatgtggcttgcgttacatatatccggtctgagttttttaggcaatttaaacaccgtgcttcttacattaataggatcttctttgatcatcgccggttcttgtgcggttaacaactattacgaccgtgatattgatcatttaatggaacgcacgaaagtaagaccgacggtaaccggaaagattcagccgaatcaagcgctgtggtcaggaattttactcattgctttaggacttatcatgcttttgatgaccaccgtgatggcagcagtcatcggttttatcggcgtgtttacgtacgttgttctttatacaatgtggacgaaacgccgttatacgattaatacggttgtcggaagtgtatcaggcgccgtgccgccgttaatcggctggacagcggttgaagggcacattggtgttgtcgcgtgggttttattcatgattttattcatctggcagattccgcactttttagcgcttgcgattaaaaagacggaagattacagagcagcgaatattccgatgcttccggtagtgcacggctttgaagtgacgaaaagacagattatcgtctgggtcgcatgcctgctgccgcttccgtttttcctcggcagtctcggtcttccgatcgtcattctcggcactttgcttaatgtcggatggcttgttctcggactgatgggattccgcatgaaaaacatcatgaagtgggcaacccttatgtttgtctattcgcttaactacatgaccatttattttgtagcgatggtggtcttcacgctgttttaattgaataatgagcttgtttgatcgccaaaacaaacaatgacaactagtaaacgccgccttgaccttttgtttaatcaggcggctttgcttttatacatagatggaattttaagtaaaaaatctcatattttaagaaatgaggaaatgaagtatttcggctggaagcagatttactgcttgtgcatctcgtactgattcaaaaaaggggttgggtgaaatgttaaagcgttggcgtcttttatcattattagccttagtgccgcttttattgagcggctgtggaaaaccgtttctgtccacactcaagcctgccggcgaagtggctgataaacaatatgatctgacggtgctcagcacacttatcatggttgtcgtcgttgcggtcgtagcagttattttcttttacgtcattgtgagattcagacggtcgcgtataggggaagacacgataccgaaacaggtggaggggaaccgttttttagaaatcacctggaccgttattccgatcctgcttctgattattcttgtcattccggttgtcattgatacattggcactggcggatacgtcgccgatggataagaaaaaccgtaaagcagaggatgcgctcgtgattaatgtaagggcgaatttatactggtgggaattcgagtatcccgattacgggtttgtgacaagtcaggagctgatcgttcccacagatgaacgcgtctatttcaagctgaagtcctcagatgtgaaacactctttctggattccgtcagccgggggaaaaatcgatacgaatacggataatgacaatactttctttctgaccttcgattctaaacgcagcaaagaagcgggagaatatttcttcgggaaatgcgcagagctgtgcgggccttcacatgcgctgatggatttcaaagtgaaaccgctgccgtcaaaagaatttaaacaatggacgaaagcgatgaaaaattataagcatacaacagattccggtttagccgcgcaaggagaagagctgtttaaggaaaaaaactgcctgagctgtcatgcggttgagcccaatgataaacgggctgaagcggcaagaacggctccgaacctcgctaccttcggtgaacgggtcaaagtggccggtattaaggatgcgaataaagagaatataaaagcctggctgaaaaatccggacagcattaaaccgggcaataaaatgacaggcacttatccgaagctctcggacgctgaaacggatgcgctgtatgaatatttaaaagggctgaaagcggagaacaagtgaggacagggagatatcaggggggaggtcgcaaatgatgaatacgcttacaggacagcaaagaaaaagctctttactttgggattatttgacgacggttgaccataagaaaatcgcgattttatatatgatcgccgggggatttttcttcgtcgtcggcggacttgaggccatgcttatcaggattcagctcttgaggccggggaacgattttatgggtgctcagcagtttaatgaaattatgacgatgcacggcacgacaatgatcttcctggcagcgatgccgctgttattcgggctgatgaacgcggttgtgccgcttcagatcggggcgcgtgacgtatcattcccatttctgaatgcgctcggattttggctgtttttcttcggaggcatctttttgaatctgagctggtttttagggggcgctcctgatgcaggctggacgtcgtacgcgtcgcttgcgctgaattcgaaagggcacggcatagactttttcgtgctcggtctgcaaatatcaggcttagggacgctcattgcgggaatcaattttctcgccacaattattaatatgagggcgccgggtttgacgtatatgagactgccgctgtttacgtggacgacatttgtggcgtcggcactcattttattcgcattccctccgctcaccgtcggtttggcgctgatgatgctggatcgtttgttcggaacgaatttctttaatcctgaattgggcggcaatacgataatctgggagcatctgttttggattttcgggcatccggaagtatacattttaattcttcccgcctttgggattttttcagaaatcattcccgtatttgcgaggaaacgtctgttcggttattcgtctatggtctttgcgatcgtgctgatcggctttctcgggttcatggtatgggttcaccacatgtttacgacgggactcggaccgatcgctaatgcgatatttgcggttgcgacgatggcgatcgcggtgcctaccggcattaaaattttcaactggcttttgaccatctggggaggaaacgtcaaattcacgacgcctatgctgtatgccgtcgcctttattccctctttcgtactcggaggagtcacaggtgtcatgctggcggccgcagcggcagattatcagttccacgatacgtattttgtcgtagcgcatttccactacgtcattatcggcggcgttgtgttcggcatcctggcgggcgtgcatttctggtggccgaaaatgttcgggaaggtgcttcatgaaacgatggggaaaatttcgttcgtcttattttttatcgggtttcatcttaccttcttcattcagcattttctcggcttgatgggaatgccgcggcgcgtttacacatatctgcccggccaggggcttgataccggcaacctgatcagttcaatcggcgcgtttttcatggcgggcgcggctgctttactcgtcgtcaatattatttatacctcaataaaggggaaatacgtcgggaacgacccgtggctggacggtcgtacgcttgaatgggcggtctcttcgccgccgccggaatataattttaaacagcttccgtttgtccggggacttgacccgctgtggattgaaaagcaggccggaaatgaagggatggcgcctgcagagcctgtagaggacattcatatgccgaacggctccatcatgccgtttatcatatctttcgggctgtttgtcgcagcgttcgggtttttataccactccgattattcatgggggcttccggttatcttcatagggctcggcatcacattctttaccatgctgcttcgctctgtggtcgatgattacggctatcatattcacaaagaagatctgccgaatgatgataaaggggtgaaggcgtaatgcagctgcaggaaaaaatgacggctgaaacctttccggcttctcctgaaaaagcaacgctggaggggaaaaataagtttttgggattttggctgtttctcggcggcgaaacagttctgttcgcctcgctatttgcgacattccttgctttacgggaatcaaaagccggagggccgtcaacggctgagatgtttgagctgccgatcgtgtttatcgcgacgatgcttcttttgacgagcagcttaacgagtgtgtatgcgatgtatcatatgaaaaatttctcctttaaaaaaatgcaggtgtggcttctggttaccgtattattgggagcgggatttttaggggttgaaatctatgaatttatgcattacactcacgaattcggctttaccattacaagctctgcgctcggctcagcgttttacacgctcgtcggcacacacggagcacacgtggcgttcgggctgttgtggatcagcgcgctcatgatccggaatgcgaaaagagggctcagcctttataatgcgccgaaatattatgtggccagcttatattggcattttatcgatgtcgtgtgggtctttatctttaccgttgtatatttgatggggatggtgggataacgatggacgataacaaaaacagagggactgtcagtacggatctcgaatatcggagaaggaaaaatgccgaggaaatgaaatatcaggtcatatccttcggcttgatgatcggccttacgcttgtcgcgtttttgacggtggctgcagacggcattgccggatggtttacgatgccgtttctgatcctgcttgcggtcattcaggtcatctttcagctgttttactttatgcatatgagccagaaggggcatgaagcgccgtcattatttctgtattcgggaatatttgtcgcgtttatcaccgtgcttgcatttgtcacgattatttggtggtaatcggggcggcggggagtgagagatttgattaatttggaaatgttcgggtttcgcgcaatgtggagcccgtatctgttttgtataactgccgtgataacaggtgtttacttttactggtgcagccggcataaaggacgtgtggccgttaaggagaaggtgctgtttgtgctttccgcgctatttttttacgcggctgcgggaagtccggttgatttattgggccatgtgatgttcagcgcccatatggcgcagatggcggttctgtttttagtcgtaccgccgctgttgatttccggaattcccggctgggcatggaaaaaactgatcttccgtcctgtcgtaaagccgctgttttcgtttttttcaatgccgcttatcgctttagtgctgtttaacggtattttttcgctgtatcacatcccgtttatatttgatttcgtcaaaacagattcgctgtatcacacgctgatgaacggactcatctttgtaacggcgttttttatgtggtggccgcttgtgcataaggtggacggtctgccccgtctcagcggtttaatgaagctggggtatattatggcagacgggattttgttaacgccggcctgcgcgctcattatgttcagcggggcgcccatgtatgccacgtatacagatccggcggcttgggccgaagcaatgaagctttgcgttcctttagatttgctggaggagatccctttatccggaccggagatgtttaacacgctgcctcctctggaagatcagcagcttggggcagtgctgatgaaaatcattcaagaggcggtctacggaatatatttggctgtcatcttttttcagtgggtcagaacggaacgggaaaaagatacgctgtcagagccgccgtatatcgagcataccgtctcataaaaaaaagtacagcagaatatgctgtacttttttattacatttgcactgtttttaatgactcttccaattcaagcagtaaagctttgctttcagcgatgacatgttccggaaattcttcagcgctgccgtattctacgccgtgcggataataatgctttcctaaaagaggggccttcagctgaatcacggcccgtctgccgccgacatcgccctcttttgccgttccttgaatccgcagataaaatgtcccctcaggtactgaaaactttttgtcgtaagtcactctttcataatcccattgtccagccagaatgagccctttaccttccatcagatcattcaagcggctgagctccgctgttaccccttcaagaccgctgttttcaaacttcaaaccttccccctccttttaaaaatgccctttcctgacaatcatagtatgaaagcgttacactttcaatgattcatacggtgaaagtatgcaaaaacaaaaatttgacgacaatagtagcagaaaaaaggaggaattccgcaatgacaaagatcaataagctcatgacgtcagacttgcaatattgtacagtattagataatgtatatgaagctgcggtgaagatgaaagacgcggatgtcggcgccattccgatagtggatgaagacggcgccacacttgtcgggatcgtgacagacagagatctcgtattacggggaattgcttcaaaaaagccgaactctcaaaaaataaccgacgcaatgacagagcgggttatcagtgcagaagaagacgcctctgtggaggaggtgctccatttgatggctgaacatcagctcagaagaattcccgtcacaagggataaaaaactggtcggcattgttacgctcggcgatctttcgttggccgagcaatcaaatgagcaagcaggccgggcgctgtctgacatttctgaagacggaggtccggaggggtttatccattaaacataaatcacggacgatgcaaataggctgtactgtataagagtaaacaataacagaacggtttgatgatatgggggtgagaggttgaaaaatatcgcaagggctctcgttatccttttgcttatttacggagcgtatgttctgtttatacaatatggatcggctcctcagaaaaagaccaatcaggaggagcctcaggtttccaatgaagaagagagcggaaaacggctgaaaatgccgtcatccggactgctttctctcatggggaaatctgccgccgatgtgaaaaagaaacttggggaaccgtcccggaaagatccttctgcctacgattacgagtggtgggtgtacaaccaggggaaagaccaatacgtacaagtcggtattttgaatgataaagccgtgactttatacgcttcgggaagcggcatcaacgcaaaaccgtttaagatcggcgaatcgacgggcgaagtttttaaaacgacgcaggtttctccttttgtcaatgtgactgacaagggaaacacgtatcggtttgagttttccgaagaagatatcaatacccgtcccaccgtcaagataggcggaatgtatgttcagctgtacatggacaaatttgacgggaacttgtcaagcatcagggcttttgatgcggaaacgcttgtgaaacaaaggccgtatgaggtcatgtacagaggaaagctgacagaacccgagccagtttctgataaaaaatggaacgacattgaacgagcgagtgaacagcagattctcgacattacaaatgtcatccgcgtgaaacacggactggcaaggctgaaatgggacgaaggcgccgcgaaagtggcattcggccacagcaaggacatgaaggataacaagtatttctctcacgtctcaaagaaatacgggactctgaaggaccgcttggaaaaaggcgatgtgaaataccgggaggccggtgaaaatattgcctacaactatgtggacggtcctgcagccgtggagggctggctgaacagcgaaggccacaggaaggcgctgttaagcccggattatacgcacctcggtgtcggcgtggaccggaagtattatacgcaaaacttcattaagccttggcagtaaaaaaccgcagaggggcgcgtcccccgcggtttttttatgttttttcgcgagcggcgctcctgctgaaaaaaatatacctgctttttttcgcaatttaggcgaacattaaggcgcatgaaccgatacattatagcaggcaaaacttttcggagggggtgagaattgtggcgaatcagcaatcacggcaatcaatcgatgattttaaacaattcgtaaaaaagcatcccaaactgatccaaaatgttcgcaaggaacaaagaagctggcaggaagtctatgaaaactgggttcttctgggcgaggatgatccgatgtgggacccttttaaagacgaggccgttcagccttcttccgacgcggaaaccaaacaggaaccagctgaaaagaacgatttcgtttcaaaaatggtcactgccgtcaaaaagatggatatcaaccaaatgaatgagcagatcaataaaatgagccagtccatttcatcattgcaaagccttttaagccaattttcggggagcagcacgaagcagccccggcaaggctccggacaacatcctttttcattcagaaaggattaaagaaggggatcgtgtatgcgaaaagaggttcaggaattcatatccgcagatgaggaacggaaacggtttatacggcagcgtcccgtctggtaccgcagacttgcgagaaaaccggacgatctcaattcttttcagcttgacatgatgaatttttatgaaaagacgataccgcatcgggtaagtcaattctcaaacgggattcaaatggcgcagatgatgatgcagatggtacacgccatgcgttcgcaggattaaaaagcgtttaaacgccgcattttccaattgggtggtttcatggtaaactagcaactggaggtgcgtatttatgtatgcaacaattgagtccgtcaagcttcaaagtgaagcggagcagcttgccggcatgattctgcagtctgagacggctgaaaattaccgcgattgttacaagcgtctccgtgaagatgaagaggcagggcggatcattcgttcttttatgagcgttaaagagcagtatgaggatgtgcagcgcttcggcaaataccatcctgattatagagagatttcccgcaaaatgagagaaatgaagcgggagctcgatttaaacgataaggtggccgaatttaaaaaagcggagactgagcttcagtcgctgcttgacgagatcagcattgaactcggaacggccgtctcggagcatgtaaaagtgccgacggggaatccttattttgacggcctgtcatcctgcggcggcggctgcggttccggcggcggctgcggatgcaaagtttcctgacgagacggccgtctcgtcttttacataaaatgaacagaaagtcaggcgggtgatcatgatggaaaataagcgccaaggcataatcgtatatctgcattccttaaaacacagcaaaatgctgagaaaattcggcaacgttcattatgtttccaagcggctgaaatacgttgtgctgtattgcgatatggacctgatcgaaaaaacaatggaaaagatttcttcttattcttatgtgaagaaggtagagccttcttataaaccttttttaaagctggaatttgaatcaaagcttgataaagcgaaagagtacgattataaagtcggcatataaaaaaatccccgcagatacctgcggggtccttctattccttaacaagttaaggagaaggaaaagggagaggagaaaccggaggaagaacttatggggaaacgtaagtcttctccgcggttggcaacaacatcattcattgatgctgttacacgtagtcttgacaggaatgtgaatatgtatacacgtttttcacgttcattgtttgaaagaatgctttatgataagatagggattgtttttatacataacggctcagccgatgagaaacatcaaagttttcagaaaaagtggtgtgaataatgagagtgatttccggttcaagaaaaggacgagccttaaaggcggtgccgggcacatcaacaaggccgacgacggataaagtaaaagagtctatttttaatatgatcggcccgtattttgacggaggaacggggctggatttgtttgcggggagcggcggtctcgggattgaagcgctgtcgcgcggatttgaccgctgtatctttgtggaccgtgatttcaaagccatccaaacggtaaaagcaaatatcaaagcgctcgatctgctggcttcagcggaagtataccgcaatgatgcagagcgggccctctatgccgcggcgaaacgggaaaaaggttttgacggaattttcttagatcctccgtataaggaacaaaagctgaaagcgcttatcgaaatgattgatgagcagaacatgctgaatgaagacggttttgtcgtagccgagcatgataaagccgttgcgcttccggaagccgtcggcgcgctttctgtaacaagaagggaaatctacgggcttacaggagtgacgatataccgaaatagggggtaatgatgtggcaagtatagctgtatgtcccggaagttttgatcccgtcacctacggacatctggatattatcagacggggggcaaacgtgtttgagcatgtgtacgtatgcgtgctcaataattcttctaagcagccgctgtttacagtcgaggaacgctgtgagctgttaagagaagtgacaaaagacattccgaatattacggtcgagacgtcacagggactgttaatcgactatgcgaaaaaaaagcgggcgaaagcgattatcagagggctcagagccgtttctgacttcgaatatgagatgcaggggacttccgtcaaccgcgtgcttgacgaatcaatagaaactttttttatgatgacgaacaatcagtactcttttttaagttcaagcatcgtaaaagaagtcgcaaaatataacgggcctgtttcagagtttgttcctccggaagttgaacaggcgctgaagcagaaatttaaaggatgagaagcgctgatcggcgtctcatcctttttttgtccgtgctgacagcctgtaacaataaatcaatgcgtatacggcgagagctgtcagcgtgatggcgggcccggtttcaacaagtgtattccatccgctgacggcagctgatcccgcgtcctgatcgcggaaagggaggaatacggactggtaaggttcgtccaatgcaaggtaaagcggcttccacagtaagagaataaagagtgcggcataaatgccctgaaggatacgcgccgcgaaaaacggtttaaagcggatatctgtttccgataaaatgccggctacctgggcctgtacggaaaggccgctgaacccgagaataaaactcacaatcatggctttcggcagcaaggcggcatcagcttcactgaccagcttgctcccaagtgtaatttcaaacattccgctgataagagggatgtccagatttgccggaagatgaaaaagtgaaagcagcgcgtttgtaaatacagaaagcacatccatgacttgtacgattgataataaccggctgaaaaccgaaaacaatataataaaaccgcccaccatcagcaaggtttgtacagaagaggtgacggcgtcgcccaaaatttttccgagcggccgcttttccgaaagccgcgccttgtggagggccagaaatgcttccttcagagaagggagagcgatcgtctttttaccggtatacgccgcttcttctttccgtccgtatgaacgcatcgtcaggccgacggcgatgtttccgagatagtgagccgatgccagcagaatgccgagagacgcgttatgaaaaaagccgaccgccacggcagcgaatataaataacggattggatgaattggtaaaagagacgaggcgttcagcctctactctggagatttgtttatcctggcgcagccgtgcagtcagcttcgcgccggccggattgcctgaagccatgcccatagccagtacaaatccgccgacccccggcactctgaaaatgggacgcataaagggttcgagtaaaaggccgacaaatttgacaatgccgaatccgattaaaagctcagatagaataaaaaacggaagcaatgaaggaaaaacgacctcccaccacatggaaagaccggttttggaggcttcgaatgaggcctgagggtgtgaaataaccgtcgctgtcaaaaaaatgaaaaacaatgaaatcaaaaatgtatgaaacttagacaaattcattcttacctccccgatgctaaaattgcacactgacatttatatcatgataaaatatagaacagaccttaaaggcggccgggcaagtacctatttgtcatcctgtactaatatacgagcataggggttcaatttagaccatagaattcatgtataggatgtctattagggggttcgtcgcgttggccaaacctacaatcgggttagcgttaggttcgggaggggcaagaggcatcgctcatctcggagtgttatccagtttacataagcatcagattccaattgatatgattgccggcagcagtatgggagcattagtcggaagcttttatgcggccgggcatgacgtggctacgatgaaaaaagtcgccaaagcatttaagcggcgggtgtacgcggattatacgatgccgaggctcggatttttaaaaggagaccgcatcaggcagcttgttcatgcctatacgtacggcaagccgatagaagaactgcggatcccgctcggcatcgtggcctgcgaccttcagaccggcgaaaaactcgtttttacgaaaggttcagtgtccgaagccgtccgcgcgagcatcagcataccgggcgttttcgtcccgcaaaaaatgaacggacgtatgttagtcgacggcgcggtggttgacagaatcccggtttccgccgtaaaagacatgggtgctgatatcgtcatcgcctctgacgtatcccgagtgaaaaaaacggaaaaagcggcacatatttttgatgtaatcatgcaaagtatggatatactgcaaaatgaattggtccgtcaccagaccattgccgcagacgtcatgatccgcccttctcttgaatcattcagctcaagttcttttgccaacattgatcatatgatcacagcgggcgaagaagccgcagaccggatgatcggccggattaaacaagaaatagagaactgggagggctaactcatatgaaagcaaaacattttcgctgggtgtttatcatcctgatcttattaattgctgttacatttattaagcttccgtattacattacacagccgggagaagcatcagagctgagaccgctgattaaggtggacggaggctatcctgaaaaaggaagcctttccttgatgactgtcaaagtaggccccgccaatccgtatacatatctttgggcgaaagtgcatccttacgatgaaatcgtccctgatgaaagcataaaagaagagggcgaatcggactcggattatatgaagcgccagctgcaaatgatgaaaagctcccaagaaaacgcggtcattgccgcttatcaaaaagccgggaaacaggtgaaatattcatttaacgggattttcgccagctcagtcgtctctgacatgccggcaaaaggaaaaatagaggtcggtgataaaatcatcagcgcggacgggaaaacatacgaatccgctgaaaagctgattgattatatcagcagcaaaaaagcgggggaaaaagtaacgtttcacattgaacgggacacgaaagaaaagaccgttgacattgtgctgaaatcattcccggacgacccgaaaagagcgggaatcggcgtcgcgttatatacggaccggaacgtgaaagtgaagccggatctccatttcagcattgaaaacatcggcgggccttctgcggggctcatgatgtctttagaaatttacaaccagctgacaaaacctgacgaaacaaaaggctataatatagccggaacggggacaatcgacgtggacggcaaggtcggaccgatcggcggaatcgatcagaaagtcgtcgccgcagacaaagcgggaaaagatattttctttgcgccgaatcaaaacggagctgaaaattctgattacaaaaatgcggtaaaaacggcgaaagcaatcaagtccgatatgaagatcgtccctgtcgacaccatgcaggacgcacttgactatttggatcagctgaaagtaaaaagcacctgatacaggcaggtgctttttttacgcattcaaaaaacgcttttcgtcttcatcatagcggatcggcgcttgtgaaaattcctgtttctcaaacaatgtgcgttcaggttcttttatcggcaggctgtaaacccgtcccgccagtatgtccagatccagagcgggatgagagaaagaagagagcttgctgacgagaggtgcggtaagctcttttttctttgccgacaggtacccctgtccttttttcgtcattccgagaagacggatataaggagcgcttgaaggctgtaaaagccgatgcatgtcttcctttttcgtccgtgtcagaatgtgcgtgttcatccgctgcagcctcgtccacgtgtatcgttttgttttcaatcgttccatcatttcgcgataggatcgggcttgtctgatggtgcgcaaaattctgtgctcaaggccttcttccacttcgtagattcggctcaattcttcagcggacagagtgctgaggctgtattttacatatgaaaaatagtcttccgtgctgtgccatatcccgtatgcatttctgtatgcctccagctcacgcgcagacgcttccgggagaaagctccttgcggccgccgttcctttttctatcagcgctttccggatgcttgttgcgctggctatccggctgttatctccgggaagctcgtcgtcatgatactgggaagcgattctggctgtcgtataaggcttcatagcggaaccgaaggcgtgtatcgctctaacgtagtgaaaaccgagaatattgttcggcttggacaaatcgagcatgtcccgccctttgaatatgtgtgaaaaagcttttgaggcggcggccggatagctgagaccctttttcagctcctctttcagaatcaggttgcagtcatcttcctttcggctgaacgcttcagacgcttcaataaagggttcgatccgcccgttttcgctgccgaaaaacaagctgctgcatcctaaatgatgaagaagcgaaacgctgccgcgcgcgaataattccgctttttgtacggcatatatataagggagctcaatgacgatatctacgccgttttccagcgccatttttgtccgggcccactttgagacggcggccggttccccgcgctgcaaaaaagggccgctcatcaccgccgccgcgacgctgctgtccgttttgatttttgcttgttccgcatgatagcggtgtccgttatgaaagggattatattcaacaaccaggccgactgctttcatatttgtcccgcctttcttgctatgttttgcttcgtgtggtacatttgcaaatgaagtgcatattttagtccgcttcgtttagtgtatgcatagcctatccggctgtcaacgattgcatgacggcggcattatgctgtaaagaaaaaatattgacaaaaacattctgaaaagctataatcatgtttgttgctttcctgaggtgatacaaatgaaatggacgatttatcagcttcatcaaatggcgaaaaagagctttgaatttgatgaaacagttgagttaaatgagctgacaaaattgaattctgacatccgccgcatttctcccgtccgggtgaagggccgcgcggagattgaatccaagcaagtttcgtttgactttacgatttcaggcgaaatggttttgccgtgctcaagaactttagttgatgtgccgtatccatttacaatcgcgacaaaagaactgtttagatttcataagtcggatgatatagaagatgaggacgttcatattgctgaagacgatatcgttgacttaactccgatcgtaaaagaagagattcttttagaaattcctatgcaagtcttttgtgaaactgaacaaaaagaaggagccgctccccaagtggggaaggattggcaagtgatttctgaggaagacaagaaaaatcaaatcgaccccagacttgcggatctgaaaaagctcttaacacaagatgatgaatcttaactctttaaggaggtgggaataatggctgtaccttttagaagaacttctaaaatgaaaaaaagattgcgccgtacacatttcaaactaaatgtacctggtatgacagaatgcccgtcatgcggagagatgaaattgtctcaccgtgtatgtaaagcatgcggatcatacaacggcaaagacataaatgttaaaagcaattaatgtatgaagaaaagcgcgggaatctcggttcctgcgcttttcttttttttttgcccctccggcctgcttccgccgaaaaaattgtgagcgccagtagtctatctaatctatcagcggcatatgtatgaggtaaatgagcaaatatggagggagatacgattgacgataacgagacaagacgcttggacgcaagatgaagatttgctgctggccgaagtggtgctcaggcatattcgggaaggcgggacccagctttccgcttttgaagaagtcggcagagcgctgacgagaacggctgccgcctgcgggttcagatggaattcttatgtcagaaaacaatatcagtcagggatagaactggcgaaaaaacagcggaaggaattaagaaagcagatcggggtgcattccgccaatctgccgggaaccgtcaaacagcctccgatccgcagggcggaaggagaaaaagagctgtccattgatgatgtcattttgtttcttcagcaatttaaagagtcgccggccgcagcggatgttcgtcatgaaaaagaaaaactcacagaacagctgaccgcgctgcaaaaagaagtcgaggatctgcgtgaggaaaatgaaagcttgagaaacaagctggagatgacggaagaagattataaagcgttaattgacattatggacagagcgagaaggatggtcaattcaaaagaagacgacaggaaatcggcgcagagcctgtaaaatgaaccggcctgagggcggcggcccggccggttttttattatgccgtttctccggatgtcatttcaccgtccatatcgggatgccagatgtaaggattttctcctttatcacgcgccatatcatatttaacgggctcaaaattcatcttatcccagaattctgctgatttcatgcgtgaatttgtcctgatcggcattctgaaagattttgcaaaatcaacaagcgcttttccgtatccgttgttttgatagcccggaagaacctcaagcttccacagttccaaaaagtcctgacgctgatcaaaatacggattcgcgcctccgtttacctgatataaactcattctcgccactagtttatccccgaagtaaatcccgtaaaaaggcgaggtgctgtcattttcaatgatattatcctgaagatcttcaagcatcgacagctcctgcatcccgtattccttaaaccttttaaattcttcgagtgtcttaaagttgatgagcaggcgctctattttcaacacaaactccccctttgttgtgttctaccattattgtaaacgctttaattgaaaattccaactataatatgcttgcctgtctttttgctcaaaacgaaattgaagtaatttgcggcggcttctgctatgataatatggaaaaatgcagatatagggtgtgacagtgtgaaaatcggaattatcggcggcggagcggtaggtcttttatgtgcttactacttatcgtcccgccatcaggtaacggtcattacgcggcggacggagcaggctgatgcgattaactcaggcggtatacggcttttgaaagacggaatagaatgtacggcggcatgcagagcgcaaacaggcatcacttccggattcgacctcttaatctcagccgttaaacagcaccagctcagtgctgtgctgcgggatcttgagacggtaaaagggacgaatgtgctgtttttgcaaaacggcatgggacacatacacgacattaaagattggcatacggatcattcgctttatgccggcactgttgagcacggagcaaaaaagatatcggatcatgccgttgaacatacgggagcgggagccgtaagatggagtgtattcagcgcatcccggccggaaacgctcaaaagcatcttttccggcatgcaccgggattttcccgtatatgatgaaaacgactggtatcggctgttaacgggaaaactgatcatcaatgtatgcatcaacccgttaactgcattgctgcgtgtgaaaaacggagagctgttaagaaatgacgcttacaaaaaatatatgagaaacgtgtttgaagaagcggagacaatacttggcctcgccgatagagaaaaagcgtggaacaaggtttgcgaagtttgcagactgacggaaaaaaatcattcttccatgctcgtcgatatcatggcaggcaggcggacagaggccgatgcgattatcggctatcttgtaaaagaagcggaaagccgcggattgccggccgttcatctcacgtttttacaccgcagcataaaagcgttagaaagaaattgaaacaaagtcttttgaggttttccggtaacatgctatactcatttcggaaacctaactatttattggagaaaggaagttccagacagatgcagctaactgaactttccatcaaaagtcaaaataagtttgtgcagcactatatagatggagaaaacatgtcttcattttttgattatgatattcattcagaggacgtatggcaaaagcggcttcatgacctctcttcgcggccgtttgccagagaggaattagcggattatttatcctcctatcacgaaaaatttcattccgacgccatgcaggcctccatcgaaaaactgagagatccaaaaagcgcagcggttgtaggcggccagcaggccggtcttttaacagggcctctttacaccatacataaaattatctccattatcgtacttgccagacagcaggaagaggcgctgcagattcctgtcgctccgatcttctgggtggccggtgaagatcacgatctggaagaaattaattatgtgcatacgtcaacagagaataaaggtccggtgaagcggaaactgccgcagtcgtactggaaaaaaacatcggcggctaaaaccgagcttgatcaggaaaaatgcgcggcttggattgatgaagtgttcgctgcttttgaggaaacggatcacacaaacacactccttcaaaacgtgaagcgatgtttacgctcatcagagacattcacggacttttttgagctgttgatcgccgacttgtttcaagaagaaggccttattctgatgaattcgggagatccggggattaaaaagctggaaacgggtatgtttcagcagattttaaaacacaatcacgagcttgccaaagctgtgtcagaccagcagcgtcttatgcgggaagccggttatcacccgattattgaatcggacaaagatcaggctaatctgttttacgaacacgagggagagcgtttcttaattgaaaaagaaaacggcgtttttgtcattaaggagcttgacctgaagtggacgaacgacgagcttcatacccatatggaagaaaaaccggaatgtttcagcaataacgttgtgacaaggccgcttatgcaggagtttctcatcccgactctggcgtttatcgcgggaccgggggagatcaattattggggtgagctgaagcaggctttctcattaatgggctttcgcatgactccggtagtgccgagactgaacattacgattcttgagcgccatattgaaaagaagctttcagaacggaatatcccgcttcaggaagcgatcgaacacggcaccggacacctgaaagacacttattttgaagagcagattccggaagagttttcttctgtaatggaacaggcgaagtcacagattgaagccgtccataaacgtgcaaggaacgaagcgctgaaggtcgattcaagccttgagccgctcttacagaagaatgccgccttcattcaggatcagctcttgtttttagaacggacggtaacgaaaagaattgaagaaaaagaaggttttgtgctgcgtgactatgaaagaatccaaaacagcatcagaccgctcggcgctccgcaggaacggatttggaatgtgatgtattatttgaaccgttacggtccaaaattcttcacaaccttcaaacatctgccattttcttttcaaaaccaacatcagattgtcaaactttgaaataaagttttaaagaaccctgaatagttcagggtttttttttatgtgtaaacagtgtaaaatgaggttgtggagagaagtggcggatagtggtgagtttaggggagaaagtgggggtccttatcatgtttatgggtgaataccagcatacaattgatgcaaagggccgcatgatcgtacccgcaaaattcagagaaggcctcggtgagcagtttgtgctgacaagaggacttgaccaatgccttttcggctatccgatgaatgaatggaagctgattgaagaaaagctgaaggctctgccgctcaccaaaaaagacgcccgcgcatttacccgattctttttttccggtgcgaccgaatgcgaactggacaagcagggaagggttaatattgcgtcatctcttctgaattacgcaaaactggaaaaagaatgtgttgtcatcggggtttccaatcgaattgaattgtggagtaaggtaatatgggaacaatacacagaagagcaagaagattcattcgctgaaattgctgaaaacatgattggatttgatatataatggatcttcgtgcatcacaacaacaactgacaattcaattcattcctgataaaggtgggaccgacacaaatgtttcagcataagacagtacttcttcgtgaaaccgtcgacggtttaaatatcaaaccggacggaacctatgtggactgcacccttggcggcgccgggcacagtacatatttattgcagcaattatcggaaaaaggacgcttgatcgcctttgaccaagatgacacggcacttgaaaacgcaaagaaaacattgtccgaatacaaaggacagctcattctggtaaaaagcaactttcgttatttaaaagagtgtttacatgaacacggcattacgagtgtcgacggaattttatttgatttaggagtatcctctccgcagcttgatacaccggaacggggattcagttatcatcatgacgcaccgctggacatgaggatggaccagtcggccgcccttacggcgaaagaagtcgtaaatgaatggcggtatgaggaccttgtgaggattttctttaaatacggagaagaaaaattcagcaagcagatcgcccggaaaattgaagaggcaagagaaaaatcgcctattcaaacaaccggccaactggtcgatctaataaaggacgcgataccggctccggcaagaagaagcggaggtcatccggccaaacgtgtattccaagccattcgaatcgccgtaaacgacgagcttcaagtatttgaagaggccctcttgcaagcgatagaggtgctgaagccgggcggaagggtgtctgtgatcacttttcactcgctggaagacagaatgtgcaagacgacattcaaggaaaaatcatcacttcccgaactgcctccgggtcttcccgtgataccggaagaatttgaaccggaattaaaactgattacgagaaagcccattacggcatcaaaagaggagcttgaagaaaataaccgcgcccggtcagcgaagctccgcattgcggagaaacgaaaataacgggcagcaaatgacaacattaaaggaggtcatcagcctatgagcaacttagcttaccagcaggaaaaacaacaacggccagtgataagtcccgaaaaaaaggtgattgtcaaaaagagggcttccattacactcggggaaaaggtgctgctcgtcctgtttgccattgccgttctctccacatcaatgtttatcgtatcaaaggcatacgcagcgtaccaatccaatattgaggtgcaaaaactagaggagaaagtatctgagaagaataagcagatcggtgatctcgaaaagacggcggctgacttaagccagccgcagcgcctgatggatatcgctaaaaagcacggtttgaatctgaaagataaaaaagtgaaaaacatacaggaatgataacccatgccgaaaaaaaataagtttatgaacagaggagcagcgatactcagtatttgtttcgctctctttttctttgtcattctcgggagaatggcgtacattcaattaaccggtaaagcaaacggtgtagaacttgcaacaaaagcgaccgagcagcacgaaaaaaagcggacgatagaagcgagccgcggctctattcttgaccgaaacggcaaagtgcttgcagaggacacggcgacatataagctcattgccgtgcttgataaaaagatgacgaccgacaagaagcatcctcagcatgtcaaagacaaagagaaaacggcggaaaaactggcgaccgttatcaatcttgataaaagcgagattctggacatcttaaacaggaatggcgcgaagcaggtggaattcggttcggccggccgcgatatctcttatgcgaaaaaacagaagatcgaaaaaatggatcttccgggtatttctttcttaagagatacgaagcgctactatccgaacggcatatttttgtcaaatgttctcggctatgccgatgtgaatgaaaaaacaaacgagatacaaggctctttagggcttgaaaaaatactgaataactatctgacggaacgtgacgggtccgtcacttacgaaagtgataaatccggctggaaacttccgaacagcaaggaaaaaatcaccgcacctaaaaacggtgacaatgtatatttaaccattgatcagaaaattcaaacctttctagaagacagcatgacgaaagtagcggaaaaatataaaccgaaaaaaattatggcggctgtcgtagaaccgaaaacaggcaaagtgcttgcgatggggcagcgtccgagttttgacccgaatatcagaaacgtcaccaattattacaacgacttagtgtcgtacgcgtatgaaccgggttcaacgatgaagatctttacgcttgccgcggcgattcaggaaaatgtgttttccgcaaacgagaaatataaatcaggaacatataaagtgggaggcaaacctgttaaagattggaacgatggcgccggatggggtatgacaagcttccatgacggcctcatgaggtcatcgaatgttgctttcgccaaactggccaacgaaaaactggggtttgaccggtttaatgagtacctgcacaaattcgggctctatcaaaaaacagggattgatctgcccggtgaagtatcaagtaaaattaactacaaatatgattttgacaaagcgtctacggcttacggccaagcatcggcgataacaccgatccagcagcttcaggccgtcacggcgattgctaataacggcaaaatgatgaaaccttacgtcattgatcatattgtcgaccccgatacgaaaaaagtcgtcaagcagacaaaaccagagcaagtaggcacgccgatttcagccgatacggcgaaaaaagtccggaacctgctcggagaagtcgtgacatcagacatcggaacggggaaaccttataaaattgaaggttttgacgtcgcgggtaaaacgggaaccgcacaaatcgccgggacgggcggatatttaaggggaacgagcaactatgtgttttcattcatgggcatggcgccgaaaaatgatcctaagctcgtcatctatgtagccgtgcagcagccgcagttaaaagcgggtcaaagcagctctgatcctgtcgcggaaatctttaacccgacgatgaaaaacagcctccactacatgaatatcgaaccgacggaaaaaacagattccggtcaggaagaaacgaaaagccaaaagatgcctgacctgacagataaaacggtcacgggcgctgagaaggaagcgaaaaatgaacacctcacaccgattgtcatcggcagcgatgttgccgtaaaagagcagtatccgacagccggagaagatgtgatcaccaatcagaaaatcttcttgaaaacagacggaaagatgacgatgccggatatgtccggatggtcgagacgggaagtgcttcaattcagcaaagtatcaggcattcacatcgatgtgagcggtgaaggttacgcttcaagccaaagtgtgaaaaaaggcaaagaactgaaagaaaataccgtgattaaggtgaaatttaaaaatcctgattaacgggacagagaagtccgcggatgcccgcgggcttcttttttatgcgcggccgttctatgtgtccaagctgaggcataaattgaaacaagcctaaataaggagtggacggtcccttgcgcgtttcaaatgtaacggttcgaaaacgtttattactggttttgctttttggcgtaatcatttttttgatcattgacagcagattaggctatgtccaatttgtgatgggggaaaagctgacttctttggctaaggattcctggagccggaatttgccgtttgagcctgagcggggagagatccttgaccgaaacggcgtgaagctggctacgaataaaagcgcgccgaccgtctttgtcgtaccgcgccagattcaaaatcccataaaaacgggcaagcttctcgcgtcagttttaaatatgtcggaagagaaggtctacaaacacattactaagaaaacctccatagaaaaaatctcacccgaggggcggaaaatttccaataaaaaagcgaaagaaatcaaagcgctcgacttaaaaggggtttatgtggctgaagacagcatccgccattatccgtacggaagctttttgtcccatgttctcggttttgccggtattgataaccagggccttctcggattggaggcttattatgatgatgacttaaaaggtgtaaagggatcagtgaaattttatacggatgccaaggggaagaaaatgcctgatgaagcggatgattatacccctccgaaagacggacttgatatgaaattgacgattgacgccaaggttcagacgattatagaaagagagctcgacaatgcagcggcgaaatataacccggacggaatgattgcggtcgcaatgaatccgaaaaacggggaagtgctcggtatgtcaagccgtcctgattttgatccggctgactatcaatccgtagatccgtccgtttacaaccggaacctgccggtatggagcacatatgaaccgggttcgacctttaagattattacgcttgcggccgctctccaagagcaaaaagtaaacttgcaaagagaccacttttatgacaaaggatttgccgaggttgacggcgcccgcctccgatgctggaaaaagggcggccacggttcgcaatcttatcttgaagtcgttcaaaattcctgcaaccctgggtttgtacagctgggggaacggctcggaaaacaaaagctgtttcaatatattaaggacttcggctttggaaagaaaacaggcattgatctgcaaggggaaggaacggggatcttattcccgcttgacagagtcggcccggtcgaacaggcgacaaccgctttcggacaaggagtttccgtcacgccgattcagcaggtggcagccgtttccgcagcaataaacggcggaacgctttatactccgtttatcgccaaagagtgggttgatcccgttacgaaaaaaaccgttaagaaacaatcgccgattgcgaaaagacaagttatttcccaggaaacgtcaaagcagatcagatatgctttagaaagcgtcgtcgctcagggaacggggcggaatgcctttgtggaaggatatcgcgtcggcggaaaaacaggtaccgcacaaaaggtcaaagacggcaaatatctcgaaaacaaccatatcgtctcctttatcggttttgcgccggctgatgacccgagccttgtcgtgtatgtcgcggttgataatccgaaaggcacgattcaattcgggggaaccgtcgccgcgccgattgtcggaaatatgatgagagacagtctgccggagctcggcgtgaaaccgcgaaaaaatcaaatcgagaaaaaatatcaatggaacgacacaaaaacaatagaggttccgaatgttgtagggatgtctgtctctgatcttgagtcgctgcttgtcaatttgaatattgactcctcaggaaaaggaagcaaaattgtgaaacaatcacctgcagccggaacgaaagtaaaagaaggctcaaagatccgtgtttacttgagtgaagaatgagtctttttgaggcagccgattgttttcggctgccttttatcataaagagaaaaaaagaagataacttttaagattaactggatgtatccttttatttacgctaaaatatgaactgtatgtttaaaagccattctgacttttataaacggttatcatgataaaagaatgaatagaatttctgagaggtttgatacaatgaaacttacaaagctgcttacatatttaatggccgaacctgttcaaaatgactttcatgaccctgacataacttcaattgagatggactccagggaagtgagaaaagggagtctttttgtgtgtataaaagggtatacggtagacggacatgatttcgctcaaaaagccgcagaaaacggcgcagcggccatcgttgccgagaaagagcttgacgtcgatgtccctgtcattatcgtccgccggtcacagcgggcgctcagcgttctttctgacgcgttttacgggcagccgacaaagcagcttcagcttatcggcatcaccggcacaaacggcaaaacatcaacgacgcacatggttgatgagattttcaaaaaagcgggaagacagaccggtttaatcggaacgatgtacattaaaatcggggatgagacattcccggtcaaaaatacaacgcccgaaagcgtcacactgcaaaaaacgttcaagaaaatgaatgatgagcatgttgacacagctattatggaagtgtcttctcacgctctgtcactcggcagggttcacggctgcgattatgatattgccgtattcacgaacctgacacaggaccatttagactatcacaagacgatggaagactacagacaggctaaaagcctcctgttttcccagctgggcggctcctttaaccatgaaaagccgaagcgggccgttttaaacgcagatgacaaagccagtgcttactttgaaaaagtgacggcggcgcacatccttacatacggaatcgagaacgatgccgatgtcatggcgaaacaaatcgagatctctgcgcaaggcacaagttttgaactcgttacgccaaaaggaacaaagcagatcacggtttcactcgtcggccgcttcaacgtgtataacgtactggctgcagcggcgacagcgatcgcagcgggtctgccgtttgatacgatcacaagcgctcttgaagagctgcaaggtgtcagaggccggtttgaactggtgaatcataatcagccgtttcctgtgatcgtcgattacgcgcacacgcctgacagtctggaaaacgttctgaatacatgcaaagacatgacagagggcaagcttttcgtcgtcgtcggctgcggcggagaccgggataaaacgaaacgcccgaaaatggcggaaattgcggtgcggattgccgacgaaccgattttcacttcagataacccgagaagcgaagaccctctggccatattaagagatatggaaagaggggtagaaggcacctactatcacagtatcgcaaaccgcgagcaggctatcttttttgccattgccaacgcgaaaaagggagatgtggttctgattgccgggaaagggcatgaaacctatcagcagatcggcaatgaaacattcgactttgatgacgccgaagtagcgggaagagctattgttgagctgaataaaaagtaaaacaggaaagagtgttagaatgagggaaatgaaaagaattacggggacacaatgtgaatatgataaatacgtatgtcgtttgaacgaaacgggaggagaaaagagcaatgcttgagcaagtgattttatttacaataataatgggatttttaatcagtgttctgatatctccgattcttatcccgtttttaagacgtttaaaattcggccaaagtatcagggaagaggggccgaaatcacatatgaaaaaatcagggacgccgacgatgggcggggtcatgattatcgtatccatcgccattacggcgattgtcatgacgcagaaattttcgcatctgagcgcggaaatgtttcttctgctgtttgttacgatcggatacggcctgctcggctttctggatgactatattaaagtagtaatgaaacggaatctcggattgacgtcgaagcagaaattgatcggccagatcattattgccattgtattttacggagtatatcattattgccatttttcaaccggcatcagggtgccgggcacacatctgtcaatcgatctcggctggggatactttatcctcgttctctttatgcttgtcggaggttcaaatgccgtcaacctgacagacggtctggacggtctcttgtccggtaccgcggctatcgcattcggcgctttcgccatccttgcgtggaaccagtcacaatatgacgttgcgattttctcggttgccgttgtcggcgccgttctcggttttcttgtattcaacgcccatcccgccaaagtatttatgggggataccggttcgcttgcgctcggaggagcgatcgtgactgttgccattctgacgaagcttgaaattctgctcgtcattatcggcggagtttttgttattgagaccttatctgttatcttacaagtcatcagctttaaaacgacaggaaaacgaatctttaagatgagtccgcttcaccaccattacgaattggtcggatggtctgaatggagagttgtcgtcacattctggactgcgggactgctgcttgccgttttaggaatttacatcgaggtgtggttataagtggaaaacgaactttttttgcaaaaacaaaactttctggtcctcggactggcgaaaagcggatatgcggctgcgtcgattcttcatgaaaaaggcattaacgtcgtcgtgaatgatcaaaaagcctttgaagagaacgaacctgccaaaaggctttcagaaagaggaatcgaggtcatctgcggtgagcatccgacgtcactttttgatcagcaccacattaccattctgatcaaaaaccccggaatcccatatgaaaatatcatggtggaggaagcgcaaagaagaggcatcccggtctggacggaaattgagcttgcgtattatatcaccaatgcaaaattcatcggcattacaggttcaaacgggaaaacaacaacgacgaccctgatttatgaaatgctgaaagctgactcgataaaggcgctgatcgcagggaatatcggcactgtcgccagtgaagtggcttatcatgctgacggtgatgaatggatcgtcacagagctttcttcgttccagcttatggggactcatgcgttcagacctgaaatcggcctgattttaaatgtgttcgacgctcatttggattaccatcacagccgtgaaaactatgaaaaagccaagcagaacgtgtatcttcatcagcttgagagtgatacggccatcgtgaatcaaagcgatgaaacagtcgtgcggcttgccgaaagcggaaaagccggcaccgttccgttttcagttcaccaggaactgtcaagcggcgcatttattaaagacggaatgctgatgttcggcgatgaagcgattctgcctgttgatgacatcgtgctgccgggcgcgcacaatttagaaaatatattggccgctgtagccgcggcaaaaacggcgggcgcgtctaataaagcgattcagaaggtgctgacaagctttaccggtgtcaaacaccgtctgcagtatgtaacagcgatccggaatcgtaaattttataatgacagcaaagcgacgaatattttggccacaagcaaagcgctctccgcgttcaaagcaccggttattctgcttgcaggcggactggaccgcggcaacggttttgacgatctgaaaccgtatatggacaatgtcaaagcggtcctgacgttcggacagacagcgccgaagatagaaaaactgggcaatgagctgggaatacaacatgtcaaacgtgtcgataatgttgaacaagcagtatctgcggcgtttgcgctctcaaatgaaggagacgtcatcctcttgtcacccgcgtgtgcaagctgggatcagttcaaaacatttgaagaacgcggtgacatgtttatagatgccgtgcatatgcttaagtaagggcttgtctctgttcatcggcagccctaaatgacttatgcttggggtgtcgattgctttgactactaaaaaaacagcgcctgatttgttattagttattattacgttattgcttttaacaataggattaattatggtctacagtgcaagtgcggtatgggcggattataaatttgacgactcgtttttcttcgcaaaacggcagctgctgtttgcggggatcggcgtcattgccatgtttttcattatgaatgtggattattggacatggcgcacatggtcgaagctgcttctgatcatttgtttttttctgcttgtgcttgtgctgattccgggagtcggaatggtgcggaacggttcaagaagctggatcggagtgggagcgttcagcattcagccttcggagtttatgaaactcgcgatgattgcgtttctggctaaatttctttctgaaaaacagaagaatattacgtcattcagacgcggattcgttcccgcgctcggaatcgtgttttctgcatttattattattatgtgccagccggacctgggaacggggacggtaatggtgggcacgtgcatcgtgatgatttttgtatccggtgcgcgaatcgctcatttcgcgtttctcggactcatcggtttaagcggatttgcggcgcttgttctgtccgctccttatcggattaaacggattacctcttacttaaacccgtgggaggacccgcttggaagcggatttcagatcattcagtcgctctatgccgtaggtccgggcggactgttcgggatggggctcggccaaagccggcaaaagtttttttacctgccggagccgcaaaccgatttcatttttgctattttatctgaggaactcggctttatcggcggttcgctcatattgctgctgttcagtattttattatggcggggcgtcaggattgccctcggcgcgccggatttatacggaagctttgtcgccatcggtattatttctatgatagctattcaagtcatgattaatatcggcgttgtgacggggctgatcccggtaacaggaattacgctgccgtttttaagctacggaggctcatcactgacgctgatgctcgcagcggtcggcgtgcttttaaatgtcagccggtactcgaggtattgatctgtatcttgcctcatcactcatgatctattcgttatctataaaaaaacagacaacatcaataaccctgtcctaaaaaacagggttatcgctatgtgattaagggggacatacgaatgcgtattgcagtaagcggaggcggaaccggaggacatatttatccggctttggcctttattaaagaagttcagcgccggcatccggatgtggaatttttgtatatcggaacagagaacggtcttgagaaaaaaattgttgaacgggaaaatatcccgttccgcgccattgaaattacaggtttcaaacgaaaactttcttttgaaaatgtaaaaaccgtcatgcgtttcttaaaaggcgtgaagaaaagcaaatcatatttaaaagagtttaaaccggatgccgttatcggtacaggcggctatgtatgcggtccggttgtatacgcggccgcaaaaatgggaattccgacgatcattcatgagcaaaacagccttccaggcatcacaaataagtttctctcgaaatatgttaataaggtggcaatttgctttgaagaggcaaaatcacattttcctgctgaaaaagttgtgtttacgggaaacccgagagcctctgaagtcgtctcaattaagacaggccgctcattaactgagttcgggctgaaagataatcaaaaaacggtgctcattttcggcggaagcagaggcgcggctcccattaatcgtgccgttatagatatgcaggaagaattgaaaacgagaccttaccaagtgctttatattaccggggaagtgcattacgagaaggtaacggctgagctgaaaggcggaaaagccgctgataatatggtgacaaaaccgtttttgcaccaaatgccggagtacttacaatcaattgatgtcattgtggcaagagccggagcgacgacgattgcggagatcaccgctctcggcattccgagcgtgcttattccgagcccgtatgtgacagccaatcaccaggaagtcaatgcgaaggcgctcagccagcatgacgctgcaatcgtactgaaggaaaccgagctcagcggagaaaaactgatcgctgcgctggacaaaatcgtcatgaatgaagaaaccttaaaagacatgagtgagcggacaaaatcactcggtgttccggatgcggcagccagactgtacagtatcatggaagacataaaaaaatagagcaaatggaatgcggaggtttatgatggagaacgtaattcaggaattaagagaccgcgaagtcggcaaagtgctggaacaagaaccgctcgcgaaccatacaacgatgaaaatcggcggtccggcggacattttaatcatccccaaccgtgtggaagcggtcaaagatattatggatattgtgaagaaacatgatctgccatggacggttatcggccgcggttcaaatctgctcgtgcttgatgaaggcataagaggagttgtcatcaaactgggggcgggtctggatcatttggagattgacggtgatcaggtgacggtcggaggcggctattcggtcgtccggcttgcgacttccatgagtaaaaaaggaatgtccggtctcgaatttgcagcgggcatccccggatcaatcggcggggccgtctatatgaatgccggggcgcacggatctgatatgagtgagattcttgtgaaagcccgtatcttatttgaagacggcacaatcgaatggctgacaaacgaagagatggatttcagctacagaacgtctgttttgcagaaaaaacgccccggcgtctgtctcgaggcagttcttcagcttgagcaaaaggaacgggaagccattacggcgcaaatgcagcagaacaaagattacagaaaaaatacgcagccgtattcaagcccatgcgccggaagcatattcagaaatccgctgccgaatcatgccggaaacctcgttgaaaaagcgggattaaaaggacatcagatcggcggagcgaaagtatccgaaatgcacgggaattttatcgtcaatgccggcggagcgactgccaaggacgttctcgacctgattgagtatgtgaaaaagacaatccgtgagcagtatgatgttgacatgcatacagaagttgaaatcatcggagggaatcgttaaaaggttctctgatttacatgagctcatgtgatatacttttaacaaatgtcaaacggcatcacagcatgccgtttgtttttcaatcagacgaatgtcaagctgtttcattcttagtgaggtggacaggcagtgaacccaaatcatgaaagagaaaaaatcgtaaatattgaagagcggattccgaaaatcaaagagcagcggaaacaaaaagcaaaccgccggctgatttcattcattgtgctcttttttatgatggtgctgatcatcgtgtacttgcagatgccgatcagcaaagtgtcttctgtcaccgtttccggaaacgaaaacgtgtctgtaaaagagatcaacgcgctttctgatatacataacggacaaaccgagttctggagtctgaacaagaaaaaaacagaagaaaagattgagcagaataaactggtgaaaaaggcggatctttcaaaagtatttcctaataaagtcagcattcacattgaagaatacaagacgatcgcgtatctgcagcggaatgatgtgtattatgaagtgctggagaacggcaccgtgctgccgaacgaagtcacgccggatgacgcgggcccgattttggttgactggacaaacgcgaaaaagcgggtcaaaatggcggaacagcttgataagctttccggttcgctaaagcagtcgatttctgaaatctattatacaccggtaaaaatggatcaggaccggatcaagctgtatatgaacgacgggtatgtagttaccgcttctattaaaacatttgccgaccggatgaagacctatccttctatcgtttcccagctggacggcgggaaaaaggggattatccacttagaagtcgctacgtattttgaagaatttaacaaaggtaaatccggcaagaaaaaagaaaatgattaatagttctaaagaactaatttagaggtgattcaaaagaatctattataatcagcggggcagccgatataaccgatagcggaataattatgactatgtttgtttttgcctgggataggctgccggacaagcggaaaattctcaatgcaatgggcgtgtcttctttaatgagcattgcatttggaattttcctcctgtttcttcttttttcggatgtttctggcaatatctatagcttttctggaggttcatcttagtgtagactaatggaaagcgggtatatttgcatctggtttacacattatggcaccgtgacaggaaatcttacggtaaggtggtccgtctctaaaaaaaataaaaaaaatgcgatataaaagaggatatacatagaatataacgaatagtttcattaaacataaattgtgagaaatcagatagaaatttgttgatgctgttgtttttgttacacacttgtaaagccacatccattgtattgttgttccgcaaataatagaatagaatttgatcgaaatgtgaggaggtgccatagaatgaacaacaatgaactttacgtcagtcttgacatcggtacgtccaatacaaaagtgatcgtcggagaaatgacagatgattcccttaacattatcggagtgggaaatgtaccgtctgaagggttgaaaaaaggctcaatcgttgatatagatgaaaccgttcattctataagaaaagcgtttgaccaagctgaaagaatggtaggttttccgctgaaaaaagccattgtcggcgttaatggaaattatattcatattcaagatacgaacggcgttgtcgctgtttccagtgaaaacaaagaaattcacgttgaagacgtccgcagggtaatggaagcggcacaggtcgtgtcggttccgcacgagcagctgatcgttgacgtcattccgaaacagtttatcgttgacggaagagacgaaattaccgatccgaaaaaaatgctcggtgtgcgcctggaagtagaaggcacgctgattaccggctccaaaacgatcttacataatttacttcgctgtgtggagagagcgggcgttgaaattactgatatctgcctgcagccgcttgcggccggttcggcggctttgtcaaaagacgaaaaaaacctcggagtcgccatgattgatatcggcggcggctcgacgacggtggcggtatttgaacaggggcacctgaaggagacagccgtcattccgctcggaggcgaaaacatcacgaaagatgtatcgatcggattgcgcacttccaccgaagaggctgaaagagtaaaaaaacaattcggacatgcattctacgatgaggcttcagaagatgaagtatttgaagtcaccgtcataggaacgaatcaaaagcaatcttttacacagcaggaaattgccaatattattgaagcaagagtggaagagattcttgagattgccgcagccgaaattgagcatatgggaattacagatctgcccggcggctttgtgctgaccggcggacaggccgcaatgcccggagtgctttcattggcacaggaagtgctgaggcacaatgtaagggtcgcaagcccgaattatatcggtgtaagagaccctcagtatatgacgggtgtcggcttgatacaatttgcctgccgaaatgccagaattcagggaagaaaaataggctttcatatgccggaagaagccgtgcaggaaatcgcggtctctcacgaagaagaacatcatcagcggcctgaggcgcagcagcgtccaaaagcaaaacaaaaaacacaagccgaacacaacaaaccgagcaaaatgaaaaaactattaagcatgttttgggaatagattgatagtcattcggcagattaggaggatttagcatgttggatttcgaaacaaacatagacggcttagcatcaattaaagtaatcggagtaggaggcggcggtaataacgcggtcaaccgaatgattgaaaatgaagtgcagggtgtagagtacattgcggtaaacacggacgcgcaagctcttaacctgtcaaaagcggaagtgaaaatgcagatcggggaaaagctgacccgcggtctcggagcgggagcgaatccggaagtcggcaaaaaagccgctgaagaaagtaaggaacaaatcgaagaagcgctaaaaggcgctgacatggtgttcgttacagccggaatgggaggcggtaccggaacgggagccgcaccggtgatcgcgcaaatcgcaaaggacttaggcgctttgactgtcggtgtcgtaacaagaccgtttacatttgaaggaagaaaacgccagctgcaggctgcaggcggtatcacggcaatgaaagaagccgttgacacactgatcgttattccgaatgaccgcattcttgaaattgtcgataaaaacacaccgatgcttgaagcattccgtgaagctgataacgtgcttcgccaaggggtgcaaggtatctctgacctcatcgcaacgcctggtttaatcaacttggactttgccgatgtcaaaaccatcatgtccaacaaaggttcagcattgatgggtatcgggatcgctacaggagaaagccgtgctgctgaagccgccaaaaaggcgatctccagtccgttactggaagcggcaatcgacggagcgcaaggtgttttgatgaacattacgggaggtacaaacctgagcctctacgaagtgcaggaagcagccgacatcgtcgcttctgcatctgaccctgatgtcaatatgattttcggttcagttatcaatgaaaatctgaaagatgaaatcgtcgtcaccgttattgcgaccggttttatcgaacaggaaaaagatgactcaaaaccgcagcgtccgaatttaaaccaaggattgaagtctcaaagccaaaacgctgcgaaacgtgagccgaaacgagaagaaacacagcatcaaaacacggtgaaccgccatacatcacagccggcggatgatgctctcgacattcctacatttttaagaaaccgcaacaaacgcggctgatgtaaaaaaggacaagactacatggttttgtcctttttcttttttgtgcacagtcttccttcctatcccccatgatctatacagtgaaaaaagaaactttatacctatgacgaattgattgttttttagtttcatacggctttctacagaatgtgacaatatctgaatggaagattgtctacatttaacgtacagcatcgaaatgacaaacgattccaattatgaaggagggatacacattttataggtcgttaccaaataaggggggatacgattgaagaaaaaaacaagaaacagatggacaggctccgttttaagcgcgattgtcgtcagttcactgttgtttccgggtggagccggagcgaacagcacaccgggggcagtttctttcaccaaagatctttcttcctctaagagcattcagcataagatttccgattcagtcaagaagcgttttgaaaaaaatgataaagtcacgtttcttatcaaatttaaagagaaagccaatacgaaaaaagcggtcaaacaagcagaaaaaaatgccgagtctcaatcgctttccgcagcaaaaaccgaatatcaaaagcggtcagccgtcgtttcttctttaaaactggcggctcatgatgcgcagcagaatctgaaaacatatttggaaaaacaaaaaaagaaaggaaaggctgatcacatccattcctattatattgtcaacggaatggcagtcactgcttcgaaagaggtaatggaaaaagccgcctcatttcctgaagtagaaaaagttcttccgaatgaaaaacgtcagcttactcaacggcatttaaaagctccttttcaaatgaagaaaaaacaaaaagagattaaagcaaaggaaggcatcgaatggaatatcagccaaattgatgcgccgcaggcctgggcctcaggatacgacggaaccgggacggttgtcgcctccattgatacgggagttcagtgggatcatcccgcgcttaaggaaaaataccggggttacgatcctgaaaatcccgcagcgccgaatcatgaaatgaactggtatgatgccgtatcccataaagacgctccctatgatgatcttgaacacggcactcatgtaacagggaccatgacgggttcagaacctgacggctcaaatcaaatcggtgtggctccgggggcgaaatggatcgcagtaaaagcattttcagatgacggaggaaccgatgccgatattttggatgccggtgaatgggtgctcgcgcctaaagataaaaacggcacgccgcatcccgagatggcgccggatgttgtcaataattcctgggcaggcggttcgggaatggacgagtggtaccgcgatatggtgaatgcgtggagagcggcagggatttttcctgaattctctgcggggaatgaagacttatttacaccgggaggaccgggttcaatcgcaaatccggccaattatcctgaagcatttgcgacaggtgcgactgacatcgacaagaaactcgctgatttctcacttcaaggcccctccccgtatcatgaaacaaaaccggacatttcggctccgggagtgaatatccgttcttctattcctggaggaacatacgaaggcggctgggacggaacttcaatggccgggccgcatgtggcggcgacggcggctttgttaaggcaggcgaacgcctctattacggtcgatgaaatggaagacgttttgacgcgcaccgccgaaaagctgacagattccgtttttccggaatcaccgaataacggttacggccacggtctcgttaacgcttttgatgccgtttctgccgtaacggacggaatcggaagcgtagaaggcaaggtatcttctgcgggcgaagatcacaatccgcccagctttcgtcatgaaccggtctcagaggcttacaaagggacaagccttccgttaacggttacagcagaagatgatgtaagcgtaactgaggtgatcctctcctatcagtttgatgaaggagagtggaaaacgacagccgccgttcaaaaaagcggtgatgaaaaaaagggaacataccaggcggagattccggacataacgggaagcaagataagttataaatggaccataaaagatttcggaggtcattctgtagaatctgatacgtaccgggctgacgtgaaaccgagcattacggcgggatacaaagaggattttgaatcacagccggcgggctggtcaagttacgggacacatgaccaatgggaatggggtatcccgggttcagggccaggcgccgcattttccggagaaaaagtgtatgcgacgaatctgtccggcccttatgctgattcggccaacatgaatctggtgatgcctccgatacaagttccggaaacagggcggctgtttttacaatttaaaagctggcacaagctcgaagaattttttgattacgggtatgtgttcgttctgccggaagggaaatcaaattgggagcaggcggccgtttacaatggtgattccgcaggatggaatgatgaagaggcggatttatctgcgtataaaggccaaaacataaagctcatgtttaatatgcagtctgacgaagtactcaatgaagacggatggtatatcgatgatgtccggctttcaagcagccctctcgggaatgcggctaaaaaaagtaaacacaatagacaaacacctcccggccacctgaagaaaaaggccgtcagtccgaaacaggccaaaccggcagtgaaatcgcccggaaaaagagtgaaacgtgaaacaaacctcctgccgctcagagcgcaaatcagtgtcgccgagacggggaaatccgtatattccgaccctgcaagcggaagctacagcatgtcacataaggcgggaagctatacgctgaaagccgaggcttacggatttaagtccgcttcgaaacaagtttctattcaatcagacaaaaccgcacaggcagactttacactggagcaaatgccgtccggcacgctaaaaggaaccatcaccaatcagtccacaggcgaaccggtaaaaggggctgcgctttatgtggccgaggatgccgcaattgaaccggcggtgacaaacgataaaggggaatactcgcttaaggcgtacgaaggctcctacacaatcaaagtagcggcaaaaggcttttacaatagcgaattttctgtcgatatcaaaggagttgctgaaaaaaacgtcaagcttaagccgtatgtcggttatgaaggggaaatcgcctatgataacgggacggaagaagccgcgctgtcatattttaaagccggcagcaaatctgccgttaagatgaccctcaaagacggaaaagaacacggtatgctgacgggaggcctttttaaattttggggcgccgactggcctgatccgggcggtaccgaatttcaagcagaagtatatgattcatccggccctgctggagctcctggcagcaaaattgccggcccgttccaagctgaagcgcttcgaaacggcgagtggaccaatgtggatctcagctcaaaaggaatcgcggtcggaaaggatttttatcttgtgttccgtcagacgaaacccgatccttatacacctgccctgtcatctgatgacggcagtccgtactcgaatagaaactggcaatacctcgacggccgctggtcaaaagccgataaatcagacggaaactttatgatcagggctttggtcgactacgaagcttctgtgcctgagataacgtcgcctgaagaccggtcatttacaaacaagaagtcaatcacggtgaaaggaacggcttcaccaaaaagcgctgtccgtcttaccaataacggtaaaaccgccgcagaaacgaaagcagatgcagacggcaatttccaggccggtgtcacactcactaaagatgccaatcggctgacggcggcatctgtgacagacagcgggtcaaccgacgagtcacgccctgtcacggtcatactggatgaggataagcctgatgtgacgattgacagtccggcaaacggtgataaaacaaataaagaagcagtgactgtaaaaggaaaagtgcacgacgaccatttaaaatgggtaaaggtgaacggaaaaaaagctgaagtaaataacggttcttatcaagcgagaacccttctggaaaacggcagcaatgagatcaaggtcacggcctcagatgaagcgggtaacaaaacaacgaaaaagacggtaatcgatgtcaattacaatgctcccgtcatttccggattggttcccggagcggataaggaattaaaagccggagaatcagtgaaaatcgctttttcaagcggaaagaaattagacgcttccttcgtgatccgtctgcctctgacaaacgcccgggcagggagccaaaacgcaacagagcttccgctgagagaaatttctccgggacgatatgagggttactggacggcggcttcttccatcaaagcaagcggagcaaaaattgacgttatcgcaagagatgactacggaaatgaaacaagacagactgctaaaggaaaactttatatcaatgagtaaaacagagcgctgccagatcacggcagcgcttttttagttgaaggggacaatagaaaatcgaccttttcggccctcgacaaataaaacggttatcccttaaaaattgtactttaccctcaacattaattgacagactttcccacagagcttgctttatacttatgaaacaagagagagaaacagatatgtaagacaaaagaggaaaggggtcagatgtgaaaatctatctggatgtcatttggctgttgaacttttgttttgattctcttttgcttttattgaccgcctttattttaaaacgccaagtgaaaaaaagaagagtggccgccggcggttttatcgggtcagccattgtgcttctgatgtttacgcctgtttctccctttgtggagcatccggcgggaaaaatggcgttttcggtagtcatcgtgcttacggcttttggctttaaacggttccgatacttttttcaaaatttgttcgccttttatttcgcgacttttctcgtcggcgggggaatgatcggcgtacattccctgctgcaaacagaatcaattgtgcagcaaggcgtaatggtcacaagccagaccggattcggcgacccgatcagctggatgtttgtagttatcggatttccggccatatggtttttttcgaaaaagagaattgaagacatcgagacgaagtccattcagtacgatgaacttgtcatggtgcaggcggaattcagcggacagacaatccgcgcgaaaggattggtggattccgggaatcagctgtatgatccgctgacgaaaacgccggtcatgatccttcacattgacaaattcgctccgattctcagcgaaaaggaaacggacctcatcaaatccgccagtccgcttgaagtgatagagcagcttgatgattcgttccgtcatgcggataagctgaggctgattccatacaggggcgtcggccaggacaatcaatttttactctgtttaaagccggattacgtcacgattttaacaaaagacgagatgatcgcatgtgaaaaatgcctgatcggcatcagcacgaagccattatccgctgacggtgaatttgacggaatcgttcacccgaagatgctgacagggaaggctgtaaaacatgtttcctgacgaaaagtctgttattcatcatactcaaaacgcgttgtatttagaagggggaggaagatgaaaaaacttaagctgcgtctgacatatttgtggtataaatggctgatgaaactcggactgaaaagcgatgaagtgtattacataggaggaagcgaggcgctgccgccgcctttgtctaaagaagaggagcaggtgctcttattaaagctgccgagcggggatcaggcggcgcgggccatcctgattgagagaaacttacgtcttgtcgtttacattgcccgcaaattcgaaaacaccggcatcaatatcgaggacttaatcagcatcggcaccatcggtttgatcaaagcggtaaacacgtttaatccggaaaagaaaatcaaactcgccacctacgcatcgcgatgtattgaaaacgaaattttaatgtacttgcgccgaaacaataaaatccgttcagaggtgtcctttgatgaaccgctgaacattgattgggacggaaacgaactgctgctttcggatgtgctcggcacagatgatgatattattacgaaagacattgaagccaatgtggataaaaaacttttgaaaaaagcgcttgagcaattaaacgaaagagaaaagcagattatggaactgcgtttcgggcttgtcggagaagaagaaaaaacccaaaaagatgtagccgacatgatggggatttcacaatcttatatctcccggctcgaaaagcggattatcaaaagactgagaaaagagtttaacaaaatggtgtaaaattttttccatctgacagcccttactgctgcaaggattgccgccgccggatgtttatttctgtaaaatggcggtgcatatttttcccacccgaggagatacttaacgttgtacagcagctcctagtgggagggaaaaacgtgtcaagaaataaagtcgaaatttgcggggtggatacctccaaattaccggtgctcaagaatgaagagatgagaaagctgtttaggcaattgcaggatgagggcgatgattcagcgagggaaaagcttgtaaacggtaatctgcgccttgtcttaagcgtcattcagaggtttaacaacagaggagagtatgttgatgacttatttcaggtcggctgcatcggactaatgaaatccattgataattttgacctaagccataatgttaagttttcaacatacgctgtaccgatgatcatcggagaaatccgcagatatttgcgggataacaatccgatccgcgtctcgaggtcgcttcgcgatatcgcatataaagcgcttcaagtaagagagcggttaatcagtgagacaagcagggagccgacagcagaggaaatcgccaaagttcttgaagtgccccatgaagaaattgtgtttgcccttgacgccattcaggatccggtttcactgtttgagccgatttataatgacggcggcgatccgatctacgtgatggaccagatcagcgatgagcgcaacaaggatacacaatggattgaggagctcgctctgaaagaaggcatgagaagactgaacgaacgggaaaaaatgattttgcgaaagcgctttttccaagggaaaacccaaatggaagtcgctgaagaaatcgggatatcccaagctcaggtctcaaggcttgaaaaggcagccattaaacaaatgaataagaatatccatcaataacggaataagcctttaaaccttgtttaaaggcttttttcatgcgatggtttacgtttgcaaaaaagtgatgtattctaatgtgtaaaagtttttagaaaatttaaataaagtaaacgggggaaactgcaatgattttacagctggacagtgtgtcattaaaaagaaacgggaaatggattttgaaagatattaactggcgcgtcgagaaaaacgaaaattgggtgctgtacggattaaacggagccggaaaaacggctttgctgaatatgttatgctcttattacttccccacttcaggagagatgcaggtgctcggccatcaattcggcaaaacagagctcggtgacaggctcaggaggaaaatcggccttgtttcggcaggtcttcagcacaaattatatgccgcggactcggcttttgaaatcgccctcagcggcgcgtacgcctcaatcgggctgtacgaaactccgagtgagcaggtaagggaaaaagcgatcggtcttctgaaggatttgggcgccatcagttacgccgacagacggtatgaaacattatcacaaggggaaagacaaagagcgctgattgcgcgggcgcttatggctgatcccaaactgctgattttggacgaacccgtgacgggtcttgattttatggcaagggagcagctgctggacacgattacgtcgatcgccgaaaaagaaaatgcgccgtccatcctttatgtcacccatcacgctgaagaaattctgccggtatttgatcaggcgctgcttttaaaacaaggcgaggtgttcgcctccgggaaaatcagggacatgctttctgacgagcggcttacagcgtttttcgatacgcctgtcaatgtcttatggaacaatggccgcccgtttttaacacgtgcaaaagcggtatcatccgtcaaataacatcaattcaccctgggggtgctgctgacatgcagctgagagagacgttgtctcaacccttaacggacctgatccggatcatgccggcggagggaagcggtgaaaaaagcggaggaagatccgttttttacccgtttcattttaatgaaacgggttttttgatacagccaaaggggagatttccaatgcatcagattgatatgctgttacaccaggcggataaacggcggggcgatttaatacaaatagctgaaaggttgatcgcctttccgacaccggctccgcctgcaagaaatacaacagaagcccaaaagtgggtggccggctttttaaaagaaacgggctgctcggtcgatatgtgggatgtgtatccggaagatccgaatgtagtcggtgttttaaaagggacagattcaagcaggcatcaaagcctgattttaaacggacacattgatgtggcagaagccgggggcgaagactggaactctgacccgtttcagccgctcgtaaaagacggcatgctgatcggaaggggcgccgctgatatgaaagggggtttggcgtgtgttcttttctctctgaagctgatccatgatgccggcattaagcttccgggcgacctcattgtacagtctgtaatcggagaagaagtcggcgaggcggggacgctggaatgctgcaaacgcggctatcacgcggattttgcggttgtcgcggatacgagcagcctgcatattcaagggcagggcggtgtcatcaccggctggatagaattgaaaagcaaacaaacatttcatgacggcatgaggcgcaatatgattcatgcgggcggaggcacattcggagcgagcgccatcgaaaaaatggcgaaaatcatcactgccttgggagagctggagcgccactgggcggtaacgaaaagctatcccggcattgcgcccggcaccaatacgatcaaccccgccgtcattgaaggcggaagacacgcagcgtttgtcgccgatgaatgccggttatggatcaccgtccacttttatccgaacgaaacgcacgaacaagcagccgcagaaatcgaagactatattaatcgtgtcgctgacagtgatctgtggctcaaagaaaacaggccggtgttcaaatggggcggatcttcgatgattgaagacagaggagaggtgttcccggcgctggaaatcgatccggatcatccggcagtttctgtcttggctgcatcacactcagccgtcaaaaaacaggagcccgtcattgatgtttcccaaacggtaacagacggagggtggctttatcaggccgggattccgagcgtcatatacggccccggcgatttaaaaaacgcccactccgtaaacgaggaagtgtccgttgatgagcttatggactatacgaaaatcatgctgagatttattctcgactggtgcagccgcaaaaaagattgcccgatgtgacaaggttcagcccggccgttcatataataggaaaaagaacgggcaaagggcgtgatacggatgatcagcatatctgaatttcaaataaaagatgtggtaaacgtgtcgaacggaaaaaaactcggaagcatcggggatattgatattaacgtgacaacgggaaaaattcaggcgattattttaggcggcagcggaaaagttctcggttttttcggaaaagaagaggaaatgatcattccttggcgaaatatagttaaaattggggaagatgtcatcttagtgcgtgtaaatgaaccaaaggggggagcgtaatcctccctttacttgtaaaaagccggaaatctcaatgtttccggcacatttatttatctcatttttcaatcagccgctaaacgtatgcttaaaattgtgttaaaatgagtgggaaattacgcttttttaatgtttgtcgaaaggttggatctccatgaatacatatcacccgtttagtcttaccaccccctcggcactcatgatagaagactggaactgtgtgaatcagcttaacacaaaggtcatcgccggattcacaacgaaaaacggcggtgtcagcaatcctccgtatgagtcattaaataccggattgcacgtccgggacgaagctcatgatgttgtgacaaaccgtgaagtcatagcgtccttatgcggtactgatctggattcctgggtgttcgccgaccagacacatgaaaaccgcgtccggcgcgtgacagccggggataaaggaaaaggagcgagagactattcttccgcattccgcgggacggacgggctctacacgaaagatgcgaatctttttttggccctttgttttgcggactgtgtgcccttgtatttttatgacccggtgaaatccattatcggcgctgcccatgccggatggaaggggacggtcaaacaaatcggacgcatcatgacggaacgctgggtaaacgaagaaggctcccgtttaacagatattcaggctgtcatcggtccgtccatcagcgcgggaagttatacagtcgacgaccgcgtcatcaatgaagtgcgggcgctgccctttacggctgaatccgccatatgcgaaacggaaaaaggccagtatcagcttgatttaaaagaggtcaaccgtcttcttctgatacattgcggcattccggaagaaaacatttcagtcagcggtttatgcaccgaacgagagcatgaactattcttttcacaccgccgcgacaaagggaaaacgggacgcatgatgtcctttatcggaatgaaggaggcataagatcttgcgtgttgctgatcaattacgacatataaacgaaagaataaacgaagcatgtaacagatcgggccgaagccccgaagatgtaaccgtcatcgcggttacaaaatacgtatcagctgaaagggctcaagaggccgttgatgccggtattacaagtctgggagaaaaccgggatgccgagcttatccataagcaggaagtcatcaaaggaagcccggagtggcactttatcggcagtcttcagtccagaaaggtgaaggccgtcgttgaccgtgtatcttatattcattccttagacagactgtcattggcaaaagagattgaaaaacgggcgcagcatgcggttcgctgttttgtgcaggtgaatacttcgcttgaaccgtctaagcacggtttgaaaacagaggaggtcatcccctttatcagagagcttgctgagtttagaaacatttctgtagagggcctgatgacgatggctcccctgacagacgatacagaaacgatcagagcctgcttccggcaattgcgtgatctgagggatcaggtgcaaaaactgaatcagacaaacgcgccgtgccgggaactgtcgatgggcatgtcaaatgattatgaaatcgctgttgaagagggcgccacttttatcagaatcggctcttcattagtcggaaatgaaccggggggtgtaaacaaatgagcatgaaaaataaactgaaaaactttttctcaatggatgaggaggagtatgagtacgaatacattgaaacggagcaggatcatcaggaagagcatgaacagcagaaagataaacagcctgcttacgctcagaagccgcagggcaagcagaacgtagtaagcttgcaaagtgttcagaaatcctctaaagtggtgttgagtgaaccgcgtgtatatgcggaagcgcaggaaatcgccgatcatttaaagaacaggcgggcggttgtcgtcaatctgcagcgcatccagcatgatcaggcgaaaagaatcgtcgactttttaagcggtaccgtctacgccatcggcggcgacattcagagaatcggttcagatatttttctgtgcacgcctgataatgtcgacgtttccggcacgatttcggagcttataaatgaagacgaacatcagaggtggtaaagcaggatgattctttatcaaattttttccgttctgagttatttaatttacatctactcgtttgccctgatcatctatatctttatgtcatgggtgccgagtacgagagaaacggcggtcggacggtttctcgcagcgatttgcgaaccgtatttagagccgttcagaaggatcattccgcccattgccatgctggatatatccccaattgtagcgattatcgtgcttcggtttgccacgacggggctttggggcctataccgcatgatcgcaatgtatacttgaatgcgacagtttgatacgggcttggcaccagccaagcctctttacatagaaaggaaagaacatgagcgatatttaccagcacttcagacaagacgagcggccttttattgatcaggtgcttgaatggaaacagattgtcctggatcagtatcggatgaagctgactgatttcttagatcccagggaacaggtgattgtaaaagccgttatcggcgacgcctgcggtcttgcgtttttcggaggatatgacagagctgagcgcaaacgcgcgattttataccctgaatatatggaacctgaacaggatgattttgagctccgggcttttgacgttcaatacgctgaaaaattcgtcagcattgaccaccgctctcttctcggatcattaatggggatcggcttaaagcggcagaaatacggcgatctgattttctcagaggaagccgtgcagctcatcgtctccggtgaaatcgccgattttgtcagcactcagctgaccaaggcgggcaaagcgccggtaaagcttgagaaaatcgagctttccgctcttcacattcccgcttcagatgtcgaaataagggatgacacggtttcttcattgcgtctcgacgccgtctgcgcttcaatgagcaggcaatcccggcagaaagcgcaggcgcttgtgaaaaacgggctcgttaaggtgaattggaaagctattgaagatccgtcttatcaggttgctgaaggggacatgctctcgattcgcggcttcggacgatgcagtttggcaaaagttgacggaaaaacgaaaaaagacaaatggaaagttacatttgaacggcaaaaatgagtcgttttttcagtttttttctccatctgtgccgtatttgttttataatgtgaactagataaccgtactgaaatgtaaaaatggaggtggcaatatgccattaacgccgaatgatatccataacaaaacgtttacaaaaggttttcgcggatatgatgaagatgaagtaaatgaatttttaatgcaggtcagaaaagattacgaaatcgcactccgtaaaaaaacggagcttgaggcgaaagtgaacgagctggacgaaaaaatcggccactttgccaatatcgaagaaacgctgaataaatcaattctcgtagcccaggaagccgcagaagacgtaaagcgcaactcgcagaaagaagcgaagctgatcgtccgtgaagcagaaaaaaatgccgatcgcatcatcaatgagtcgctttccaaatcaagaaaaatcgcaatggaaatcgaagagctgaaaaaacagtctaaagtcttcagaacacgtttccaaatgctgattgaagcgcagctcgacctgctgaagaacgatgattgggatcatctgctggaatacgaagtcgacgcggtatttgaggaaaaagaataattttctgattttcttgacattcttcggcccgttcgaatataatacgttcataaattcagatgaaaagacgattgaaagggaccggcatgactcaaaacaggctataaagcgaaccggggaaggtgaaagcccgggatggccggaatcatgcagatcagccctttagtttcctttctgaaccgagagtaggaaaggacgttccatcacgttacgatgttcgagaggaaaagacggatgatccgttttttctaaaagggtggtaccgcgagataagctttctcgtcccttatgggatgagagggctttttttattttctgaaaaatgttgtggaggaatgaaaatggattacaaagatacgctgttaatgccgaaaacagattttccgatgcggggaaatctgccgaatcgtgagccggacatgcaaaaagactgggaggagcaggatatttaccgtcttgttcaagaacggacgaaagaccgcccgaaattcgtgctgcatgacggacctccttatgcaaacggagacatccacatgggccatgccctgaacaaaatcctgaaagacttcatcgtccgctataaatcaatgagcggctacaacgcaccgtacgtgccgggctgggatacgcacggactgccgattgaaacggcgctgacgaaaaacaaaaaagtaaaccggaaagaaatgtccgtcgctgatttccgcaagctttgcgaagattatgcatggcagcagatcgaaagacagcgcgaacaattcaagcgtctcggcgtcagaggcgattgggaaaacccgtatgttacgcttcagcctgaatttgaagcgcagcagatccgcgttttcggcgagatggcgaaaagaggctatatttataaaggtctgaagccggtcaactggtcgccttcaagtgaatctgccttagcagaagcggaaattgaatatcaggacaaacgttccgcgtctatttatgttgcgtttaaggtgaaagacggtaaaggcgttctggaaaacggagaaagcttcatcatctggacgacgacgccgtggacgatgcctgccaacctcggaatttccgttcatcctgatcttgaatacaatgtcatcaaggttggagacaagcgttatgtagtggcggctgaactgatcgaaaatgtagcggaggcatgcggctttgaaaatcctgaagttgtcgcatcatataaaggcagagaattagaatacatcactgcagaacatccgctgtacggcagagattcactcgtcatgctcggtgaccacgtcacaaccgatgccggaacaggctgtgttcatactgccccgggccacggggaagatgactttatcgtcggccaaaagtacggcttagaagtactgtgccctgttgatgaaaaaggaaacatgaccgacgaagcgccgggctttgaaggaatgttttacgataaagccaataaaccgatcacggagaagcttgaagaaaacggcgcgctcttgaaactcgagtttattacacactcctatccgcatgactggagaacgaaaaaaccgaccatcttcagagcgacagcgcaatggtttgcgtcaattaaagatttcagatccgatctgcttgatgccatcaaacaaacgaagtgggtgccggagtggggcgaacagcgcctttacaacatggttcgcgaccgcggtgactggtgtatctcaaggcagcgcgtgtggggtgttccgatcccggtattttatgcagaaaacggtgagccgatcatcactgacgaaacgattgaacatgtgtctgagctgttcaaacagcacggctcaaacgtctggtttgaaagagaggcaaaagacctcctgccggaaggatttacacatccgggaagcccgaacggaatcttcacgaaagagcaagacattatggatgtatggtttgattcgggttcttcccatcaggccgttcttgaagaacgagatgatcttgtccgtccggctgatttataccttgaaggctctgaccaataccgcggctggtttaactcatctctttccaccgctgttgcagtcaccggcaaagcgccgtataaaggcgtattaagccacggatttacacttgatgcaaacggccgtaaaatgagtaaatcactcggcaatacgattgacccgacaaaaatcgcaaaacagcttggagctgaaattctgcgtttatgggtatcttccgtaaactatcaggccgatcacccggtttctgaagatattctgaagcaggtcgcggaagtataccggaaagtccgcaacacgttccgcttccttcacggcaacctgttcgatttcgaaccaagcgtcaatgccgtggatgtaaaagatctccgcgaagtggatcaatatatgctgatcaagctgaataagctgatcgataaggtgaaaaaagcgtacgatgaatacgaatttgcggttgtttatcacagcattcacaatttctgtacgatcgagctcagctcattctatcttgattttgcaaaagatgttgtgtacatcgagcatgcggatcatccggaccgccgcagcatgcagactgtcttttatgaaacgctgctggcgttagtgaaactgacggcgccgattctcccgcatacggcggatgaaatgtggtctcacttatcatttgttgaagaagcgagcgtgcagctgacagatatgccggaaaccattgctgttccggacagtcaagcgacagaagaaaaattcgatcgcttcatggagcttcgaaacgacgtgctgaaagctttggaaacagcccgtaacgaaaaaattatcggaagatcattggaagcgagcctgactttgtatccgaacaaagaaaaccgcgacctcttgtcatccattaaagaaaacatcgcgcagctgtttatcgtctcagaactgacagtaaaagacgaaagtgaagcgccggaaaacgcgcaaagcttcacaacaggaaaaatgaccgtagaaaaagcggaaggccagatgtgtgagcgttcccgcataatttctaaagatgtcggagccaatccgaaatatccgacattatcactgcgcaatgcggaaatcgttgaaaaatattatcaaaaataataaatgagaaagcgcccggtgtcagccgggcgcttttttacatgccagcaatgtcatcgattagaacggcaggaaaattcttatgggcttcaaatggcgctctgagggcaacaataaagctataacatcaaaagcaggagttgtgatgaatgaatgatcaactgaccgcaatccacacggagcttctcatgatgaaagaagaacttcaatcaagattattcgaatattcttgctttcaaatgtcagcatctgttgaaccttcaatgaacgaccaagaagcaactctgatctatcatataaaagaagaacttcaggatgttcttcttgccctgtctaagtttgaaaacaatacgtacggttattgtgaaaaaacaggcgcccccattccgattgaaaaacttgcggtgttgccgacggccagaaccgctgatgatttttattatcccgctcaatttgaaaagaaaacccttccatattgggaacccggagattatgcatatgatcaggcgctgtatgagtgacagcgtctgtttgtatacgcttatgatctgcctttactctggcatcttttactgataaaattcataaaggataaaagtaactgtatactggaggaacgtgtgtgctttattatcttatcgctctttttattattattgccgaccaattgaccaaatggcttgtcgtcagccatatggaattgggacaaagcatacctgtcatcgaccaggtgctttatatcacatctcatcgcaacacgggagcggcgtgggggattttagccggccaaatgtggtttttctacgtcattaccatcgccgtgattatcggaatcgtttattacatacagcgttatgcaaaagggcagatgttactcggaatttctctcggcttaatgctgggaggtgcggccggaaactttattgaccgggcggcgcgccaggaagtggtggattttattcatgtcatcatcgtggattatcactatccgatttttaatatcgcggactcctcactgtgcgtcggtgtaatacttttatttattcatatgctgtttgacagcgggaaaaagaaggagcaataacatgaatcaatttgagataaccgttcagcctgaacaaaagagcgaacggattgataaatttttggcttcaacgggagaaaactggtcacgcactcaagtgcagcaatgggtaaaagagggactggtatccgttaacggcaaatccgtaaaagcgaattataaaatgcagcccggcgatcaggtaaacgtcaccattcctgaaccggaagaattggacgtgcttgcagagccgatggatttggacatttactatgaagaccaggatgtcttggttgtgaacaaaccgcggggcatggtcgtacatccggcgcccggccatgtgacagggacgctcgtaaacggactgatggctcactgcaatgatctttccggcattaacggcgtcatgcgcccgggaatcgtccatcggattgataaagatacctccggcctgttaatggtcgccaaaaacgatatggcgcatgaatcactcgttaatcagctcgtcaataaaaccgtgacgagaaagtacacagcggttgtccacgggttgatttcacatgatgacggaacgattgacgctccgatcggaagagataagaaagaccgtcaaagcatgaccgtaacaagagaaagcagcaaaaatgccgtcacgcatttccacgtgcttgagcgttttcaagacttcacgctcgtagagtgccgtcttgagaccggaagaacgcatcagatccgtgttcatatgaaatatatcggatttcctttggcaggcgacccgaagtacggaccgagaaaaaccattgatttcaacggtcaggcgcttcatgccggaatattaggttttgaccatccgcggacgggcgaatacatggagtttgaagcgccccttcctgaagatatgaaaaaactcattgaacatttgagaaatagccattgacagcgagtttcttttctggaataataaaaacaagctgaatagattctttaacacagtccagagaggctgagaaggataacggataggacagaagagatacacgtgtgtcttcgtcctggaaaggaacccctctatgctctggcaggaggggttttttcttcttatatacgaatggagaggtgtcacgagtgaatcaaaaagctgttattctcgacgaacaggcgatcaggcgggcgctgacaaggatagctcatgaaatgatcgaacggaataaaggaatgaatgactgcattcttgtagggattaaaacaagaggtatttatttagcgaagcggctggccgagcggatcgaacagattgaaggaaatccggtcaccgtcggggaaatcgatatcaccctttaccgtgacgatctcacaaaaaaaacgagcaatgaagagccgcttgtaaaaggcgcggacattccggccgatatcacagaccaaaaggtcattgtggttgatgatgtgctttataccggccggacggtgagagctgcgatggatgctctcgttgatgtcgggcggccgtcatcgatacagcttgccgtgcttgtcgacagaggacaccgggagctgccgatcagagcggactatatcgggaaaaacattccgacctcaaaagctgaaaaagtgatggttcagctgagcgaagttgatcagactgatatggtcgccatttacgaaaatgaataatcaccctttttaaatgcattccagagagtttgcaaagaggattttaaaacacaaagccgggcggatcgacgcggccgggctttgtatgcctctttgcgcaaaaagcaaagaggtttttttataccatttgaaagtcaaccgggaggaaaacgccatgagtaagaaaaaagtaaacctgggagtcagggacgtccccaatccattgtcctggctgtcattcagcctgcagcatttattcgccatgttcggttcaaccatactcgtgccgaaactggtcggaatgagcccggcagtggcgcttgtcacgagcggaatcgggacactcgcctatctcttggtgacaaaaggccagattcccgcttatctcggctcatcattcgcctttatatcaccgattatcttggtgaaggcgacgggagggccgggggctgccatggtcggcgctttcctggcggggattgtgtacggcctgatcgcactgctcatcaggcagcttggaacggggtggctgatgaagctgctgccccccgtggtcgtcgggccggtcatcatcgtcatcggcctcggactggcaagcacagccgtcaatatggcaatgtatgctgatccgaatgcgaaggaactcgtctacagcctgaaacatttcagtgtagccggcgtcactttggccatcaccattatctgcgccatctttttacggggatttttaagcttgattccggtattgatcggcattataggcggatatctgtttgcgctgacacagggcatcgtcaattttcagccggtcattgatgcaaaatggttcgccgttcctgaatttatcatccctttcaaagactacacgccgtcagtgacattgggcattgccgctgcgatggtgccggtcgctttcgtgacgatgtcagaacatatcggccaccaaatggtgctgagtaaagttgtcggacaggatttcattaaaaagccgggactgcaccgctccataatgggggacagcgtagcgacgatcatcgcttcgttaatcggcggcccgccgacgacaacatacggcgaaaacatcggtgtcctggcaattacgagagttttcagcgtctttgtcatcggcggcgcgggagtgattgcgctgtgcttcggatttatcggcaaagtttcagcgctgatcagctctgttccgtccgcggttatgggaggcgtttccttcctgctcttcggaattatcgcctccagcggcttaagaatgctgattgacaacaacattgattatgaaaacaagcggaatttaattatcacatccgtcatcctcgtgatcggcgtcggaggggcttttattcaagtatcaaaaggcgggttccaaatatccggcatggcgcttgcggcaatcgtcggagtcatcctgaaccttatcctgccgcatgcaaatgaagaagacgcgattgcatcagaaaaacaaaatcatatgtaaaccttttaaagaaagtccagagaggcttggaagggttataacgggaagaagctgtacggctcttctctctttaaccgcaccccgagtctatagaccggggtgttttttacggccttcaagcggaaacggaggagaaaaaacatgaatcatttaacggcgatgtctgaactgagcgcggctgaaattacagaactgctgcgagaggcaaaagcgataaaagagggtgcagtccgtcccgatctcgcgggaaaattcgttgcgaatctgttttttgaaccgagcacgagaacgcggttcagctttgaagtggcggaaaagaaactcgggatgaacgtgctcagcttagacggcacgagcacaagcgttcaaaaaggcgagtccttatacgacacggtcaaaacactggaatcaatcggagcggatgcctgcgtcatcaggcacagcacggatgaatattacaaagatctgaccggcagagtcaatattccgatcttaaacgccggcgacggctgcggccagcacccgactcagtcattgctcgatttaatgacgattcaagaggaatttgagacctttcagggcctgacggtttccattcatggcgatatcaaacacagcagggtggcaaggtcaaatgccgaggtgctgacaaggctcggcgcacgtgtgctgttttctggtccgccgcagtggcaggatgagaaaaacgccttcggcacctgtgttcagacggatgaagccatacaagcttcagatgtcgtcatgctgctccgcatccaaaatgaaaggcatcagacagaagccgaccaaaaaggctacctggaagcatacgggctgaccgcaaagcgggcggagagcatgaagcggcatgccatcatcatgcatcccgcaccggtgaacagaggagtcgaaattgacacaacattagtggaatgcggaaaatcaagaatctttaaacaaatggaaaatggtgtgtatatcagaatggcagtattaaaaagagcactgcaaaccaatgtgaaaaggggagaagcggcttatgtcttatctcattaaaaacggctggatgttaaatgaacagggagaaaaagcggcacaggatatccgggtaacgggtgaattcatttcggaaaccgggcttctgacagcgaaagacggagaaacggtgatcgacgctgagggactgttcgtttcacctgggctcgtagaccttcatgtccacttcagagaaccgggcggcgagaaaaaagaaaccattgagacgggctctaaagccgcggtgcgcggcggttttaccacagtcgccgccatgccgaatacaagaccggtgccggatacgaaagagcagatggaatggctgcaaaacaggatcaaagaaacctcatctgtcagggtccttccttacgcatcgattacgatcagacaaaccggcgaagaaatgacagattttgaggcgcttcatgaagcgggcgcattcgccttcaccgatgacggcgtcggcgttcagacggccggaatgatgtatgaagccatgaaacgggcggcttcaataaataaagcgattgtcgctcattgtgaggataactcgcttatttacggcggaagcgtgcatgaaggatctttttcaaaagcgaacggcctgaacggcataccttccatttgtgaagcggtacatattgcccgtgacgtcctgctggcggaagcggcgggctgccattaccacgtgtgtcatatcagcacgaaagaatccgtcagagccgtaagagacgcaaaaaaagcgggaatccgcgtgacggccgaagtatcgccgcaccacctgctgctttgtgacgaagatatcccgggacttgataccaattttaagatgaatccgccgcttcgcagcaaagaggacagagaggcgctgattgaagggcttttagacggtacgattgatttcatcgccactgaccatgcgccgcatacagaagaagagaaaaacacggacatgaagcttgcgcctttcggtatcgtcggtttagaaactgcctttccgcttctgtacacacattttgtgaaaaacggggcgtggacgctgaagcagctggttgatttcatgacggtaaaaccttgcgaggcattcggtcttccgtacggaacgcttgcaccgggggcgccggctgacatcaccctgattgatctggaaaaagaagcggccattgacaaagatacatttttatctaaaggaaaaaatacgccattcaacaagatgaagtgcttcggctggcctgttgcaacgatggctgccggtaaacttgcatacgaagaagggagactcgtcaaatgaaaagaagactagtgctggaaaatggagcggtatttgagggtgaagcattcgggagcctggagcatactgcgggtgaagtcgtattcaacacgggaatgaccggttatcaggaaattttatcagacccgtcttactgcgggcagatcgtgacgctgacgtatccgctgatcggcaactacggaattaacagagatgactttgaatccatcactccttttgtaaaagggctgatcgtaaaagaactgtgcgagctgccttccaactggcgttcggcttacacgcttgacgagtatctgaaaatgaaaaatatccccggcttacaagggatcgacacgcgaaaactcaccagaatgatccgcacggccggcgcattaaaaggaacgtttgcttcaagtgaggagaatgtcggagaggttcttgcaaggctgaaagaaacggaactgccgagaaatcaagtcgctcaagtatcggcgaaaacggcatatccgagtccgggccgcggcaaacgcatcgtgctcgtcgatttcggtatgaagcacggcatcttaagagagttaaacaaaagaaaatgcgatgtcatcgttgtaccgtacaatgtaacggcggaagaagtgcttcagctcaagccggacggcatcatgctttctaacggacccggagatccgaaagatgtgccggaagccattgaaatgataaaaggcatactcgggaaggtgccgttattcggaatctgcctcggccaccaattatttgcgctggcatcgggagcggaaacggaaaaaatgaaattcggacacaggggttccaatcatccggttaaagagcttgcgacagggaaagtcgctttaacagcccaaaaccacggatatacagtttcttcaatagatgagacagagcttgaagtgacgcatattgcgatcaatgatcaaacgatcgaaggactcaagcataaaacattgccggcatttacggttcagtaccaccctgaagcttcaccggggccggaagacgccaatcaattatttgacagattcattgacttgatcgaaacaactgagaaagaaggggaagcggtatgccaaaacgcgtagatattaaaaagattttagtgatcggatcaggcccgattattatcggacaggcggcggaatttgattatgcgggcacacaggcgtgtctcgctttaaaggaagaaggctatgaagttattctcgtcaactcgaatccggcaacgattatgacggatacggaaatggctgatcgggtatacatagaaccgctgacgccggagtttctcacgcgtattatcagaaaagaacggccggacgccatcctgccgactctgggcggacagaccggactgaatcttgccgtcgagctgtctgaactcggggttcttgaggaatgcggagtggaagtgctcggcacaaagctgtccgccatccagcaggcggaagaccgcgacttattccgtacgctgatgaatgagctgaatgaaccggtgccggaaagtgagatcatccgcactttacaggaagccgaggaatttgtcggccggatcgggtttccggttatcgtgcgccccgcttacacattaggcggaacgggcggcggcatctgctctaatgaagcagaactgaaagagatcgtcgaaaacggattaaagctcagccccgttcatcagtgccttctggaaaaaagcattgccggttacaaagagatcgaatatgaagtcatgagagacagcagagatcacgcgatcgtcgtctgcaatatggaaaatatcgatccggtcggcatccatacgggcgacagcatcgtcgttgccccgagccagactttgagcgaccgggaatatcagcttttgcgcaatgtttcattaaagctgatccgcgcgctcggcattgaaggcggctgtaatgttcagctcgcgctcgatcccgacagcttccaatattacattatcgaagtgaatccgcgggtgagccgctcatctgccctcgcttcaaaagcgacgggttacccgatcgcaaagcttgcggcgaaaatcgcagtcgggctttctcttgatgaaatgatgaaccccgtaacgggaaaaacatatgcggcttttgagcccgcgcttgactatgtcgtttctaaaatcccgcgctggccgttcgacaaatttgagtcggcaaaccgcaggctcgggacgcaaatgaaagccaccggagaggtcatggccatcggacgcacccttgaagaatcgctgttaaaggcggtccgctcactggaagccgatgtctatcacctggaactgaaggatgcggaagagatttctgacgggcttttggaaaaacggatcagaaaggccggagatgaacggctgttttatctcgcagaagcgttcagaagaggctacacagtggagcagcttcatgagttttccgcaattgacgtattctttttgcacaagctctctaagctggtcgcttttgaaaccgagctgaaagcggaaaaaggcagcctcgccgtcctgcagacagcgaaggaactcggtttctccgacaaatatatcagccgggaatggaatatgccggaacaagagctgtatcaaatgcgaaaagaagcagccatcaagcctgtatataaaatggtggatacatgcgcggcggaattcgaatcagaaaccccgtatttttacagcacatatgaggaagaaaacgagtctgaggtaacatcaagaaaaagcgtcgtcgtcctcggttccggcccgatccgcatcggacagggcgtcgaatttgactatgcgaccgttcattctgtctgggccatcaagcaggcaggctatgaagcgattattatcaacaacaaccctgagacggtgtccactgatttcagcatatcagacaaactgtattttgaaccgctgacggtagaagatgtcatgcacatcatcgatttggaacagccggaaggcgttgttgtccaattcggcggccagacggcgatcaaccttgcggaagaattgagcgcccgcggcgtcaaaatcctcggtacatcacttgaagatttagaccgtgcggaagaccgggataagttcgagcaggcgcttgaggcgctgaatgtgccgcagccgctcggaaaaaccgccgtgtcggtgaacgaagcggtcaaaatcgctgcatccatcggctatccggtacttgtccgcccttcgtatgtgctcggcggccgggcgatggaaatcgtctatcacgaagaagagctccttcactatatgaaaaatgcggtcaaaatcaacccgcagcatccggtgttaatcgaccgttatctgacggggaaagaaatcgaagtcgatgccgtatctgacggcgaaacagtcgttattccgggaattatggagcatatcgagcgggccggcgtccattcaggggattcaatcgccgtctatccgcctcagtctttaagcggagacattaagaaaaaaatcgaacaatacactgtagccttggcaaaaggccttaacatcatcgggttgctgaacatccagttcgtactttcgcaaggtgaggtgtatgtgcttgaggtaaatccgcggtcaagcagaaccgtgccgttcttaagcaaaatcactaagattccgatggcgaatctggcgacaaaggtcattctcggccaaaagcttgctgatttcggctatcaagaggggctgcagcctgaacagcagggggtattcgtgaaagcgcctgtcttctcattcgcgaagctgagaagagtggatattacgttaggccctgaaatgaagtcgacgggagaggtcatgggcaaagattcaaccttggaaaaagcgctctataaagcgctgattgcctctggcattcaaatcccgaactacggctcagtgctgttgaccgttgctgataaagataaagaagaaggactgctgatcgccaagcggttccacgccatcggctataaaatcttggcgacggaaggaacggcggcttatttgaaagacgctcagattccggctcaagtcgtcgggaaaatcggcgaagaagggaaaaatctgctcgatgtgatcagaaacggcgaagcgcaatttgtcatcaatacgctgacaaagggcaaacagccggccagagacggcttcagaatccgccgcgaatccgttgagaacggagtcgcctgcctgacatctttagatacggccgaagccattttgcgggtattggaaagcatgacattccgggcggatcatatgcctgcatccgaaaccaatcaaaaggcggcagtcacgatatgaaaaaagcgcatttgactgttcaatccaacttagaaattgccgaccggatttataagatggtgctgaaaggagagcttgtccggcaccttaccgagccgggtcaatttcttcatctgaaggtgagtgacgcggtcacaccgctattaagaagaccgctcagcattgcggacgtcaatttcgccgcggatgaagtatccgttatctacagagctgacggtgagggaacgcgtcttttgtccgggaaaaaagagggcggcaggatagacgttctcggccctctcggcaacggatttcccgtccggcggattgaacccggcaaaaccgcgctgttagtcggaggcggagtgggggttccgcctttgcaggaactgtcaaagcgcctgacggaaaaaggcgtaaacgtcattcatgtgcttggatttcaatcagcaaaggatgttttttacgaacaggaatgccgtgcgtacggagacacctatgtggcgacggctgacggaacatatggagagaaaggatttgtcaccgatgtcatccgtgaaaagcagctcgaattcgatgtcctgctaagctgcggaccgacaccgatgctgaaagctctgaagcagcagtacggccataaagaggtttatctttcgatggaagagcggatgggctgcggcatcggggcctgcttcgcctgcgtgtgccgcacgggtgaaagcgatacatcctatgtaaaggtctgcctggacgggcctgtatttaaagctgaggaggtggcgctgtaatgttagaggtgaatctgccgggtctccaattgaaaaacccgatcatccccgcttccggatgtttcggtttcgggaaagaatatgccggattttacgatttatcatgcctcggaggcattatgattaaagcaacgacgaacgaagcccgcttcggaaatccgacaccgagagtggcggagacaagcgcgggaatgctgaatgccatcggactgcaaaatcccggccttgagcatgtgctcaatcatgagctgccttggctcgaacaatttgacacgccgattatcgcaaatgtcgccggttctcaggtggacgactataaagaagtggccgagcacatcagccaagcgccgaatgtgcatgcgcttgagcttaacatttcatgtccgaatgtcaaaacgggggggattgcttttggtactgatcccgtcatggcggccgaactgacaaaagcggtgaaagaagtttccgcagtgcctgtgtatgtgaagctttcgcctaatgtcgcaaacataaccgaaattgccaaagcgattgaagcggccggtgctgacggtctgacgatgattaatactctcatcgggatgaggctcgatctcaagacgggccggccgattttagcaaataaaacgggcggactgtcaggcccggcgatcaaaccggtcgccatccggatggtatacgaagtcagccaggccgttcaaattccgattatcgggatgggcggcgttcagaccgcagaggatgcattagaatttcttcttgcgggagcgagtgcggttgccgtcggcacggcgaacttcgtcaatccgttcgtctgcccggaaatcatagaacagctcccccgtgtgctgcgccaacacggctttcaatctgtaagtgaatgcatcggaaggagctggaaacatgaaaaacaacctgcccatcatcgcgcttgattttgcatcaggggaagagactttaacgtttttagacttgtttgaaaaggaaaggctctttgtcaaaacggggatggaacttttttatcaggaaggccccgccatcattcaccaattaaaagaacggaactgtgatatatttttagatttaaagcttcatgatatcccgactacggtcaataaagcgatgaagcggctggcccgcctcggcgttgatctcgtcaatgtgcatgcggcagggggcgcacgcatgatgcgcgcggcccttgaggggcttgaagaaggcacgccggcaggcagaaaacgcccgtctttaatcgcggtgactcagctgaccagcacttcagagcaggtggcgaaggaagagcttctgctgcataagccgctgttagaaacggttgtgcattacggcaaaatggcggaagagtgcgggctggacggagtggtatgttcggtccatgaaacaaaagccatttatgaagcggtccggccttcatttctgacagtcacgccgggcatccgcacggccagtgacgcagctgacgatcaagtccggacggcgactccgtcatttgcgaaagaaaacggttcgtcagccatcgtcgtgggccgctcaattacaaaagcggaaaaccccgttaaagcatatgaagcaattaaactggaatgggagggcgttcgccgatgaaacaggctatcgcaaaacatctattacacattgaagctgtctttttacgtccgaatgagccgtttacgtgggcgagcggcattttatcaccgatctattgtgacaaccgtctgacattgtcgtatccaaaagtgagaaatgatgtggcggacgggctcggcaaactgctgaaggagcatttccccgaggcggagatgatcgcgggcactgcaacggcgggcattccgcatgctgcgcttctcgcagaccgtacaggcgcgccgatgtgctacgtcagaagcaaaccgaaagcgcacggcaaaggaaatcaaatagaaggcgccattaagaaaggacaaaaaacagtcgtgattgaagacttgatttctaccggaggcagcgtgcttgaagcagcggcggcccttcaaagagagggcgcggaagtcctcggcgtcatttccatttttacatacggactgccgaaagcaaaagaagcctttaaaaaagcgggtcttccttattactcgttaaccgattatgacacgctgattgaagtcgcgcttgaaaacggaacgattcattcagctgacattgaaaaactgaaatcatggaaactgaatcccgagtcaaaagattggtttaaaaaataatgacaataaaaacaggcctcagggcctgttttattattcctatcaaaaaactcgggttgacttctgttagaattgtgctaaaatttagtacaaatctaaaaagcttatcaagagcggctgagggactggaccgatgacgcccggcaacctgcgtgtattgcaaggtgccgcatccagaaaaatgcacagcattttgaagataagggctataccgggtcactgtctttcattccgctggattgaaagttttttatataaaaaaaagattgagggataagacaaccggcagagaacaacagctgtttgattgtctccgggaggaggaaagaaaaaatgctaacgtatgacacatgggaagagccggcgattacatttccggaagacgattcctataaaggcgcgctgtccgttttaaaatgggcatacggccactacggagaccagcttgtttacgcgtgcagcttcgggattgagggcatcgtcctgatcgatttaatttctaaagtaaagaaagacgcggaaatcgtgtttctcgatacgggtcttcactttaaagaaacatatgaaacgatcgaaaaagtgaaagaacgttacccggggctgaacattatcctgaaaaagcccagccttactctcgaggaacaggccgaggctcacggagataaactgtgggaaagagaaccgaaccagtgctgctacatcagaaaaattctgccgttaagagaagcactcgcagggcatccggcatggctgtccggccttcgccgggatcaagggccgagccgggcgaatacgaatttcctgaataaagacgacaagtttcaatcgattaaagtatgcccgctgatccattggacatggaaagacatctggagatatacttccaagcatgagctggattacaatatcctccatgatcaggggtatccgagcatcggctgtgaaccgtgcacttcacctgcgtttaccgcggaagatttgcggagcggcagatggaacggcatggcgaaaacagaatgcggactgcatgaataaaggagctgcccgatggaattagccgctattttattctgtctgttttttgccatgaatatcggagccagcggagccgcggcatcaatgggagttgcttacgggtccggcgccgttaaaaagaaaacgtatgcgctgatcatctgcgcggccggagtcctgtcaggggcggttatcggcggcggtgaagtcgttaagacgatcagcggcggaatcattcccgaacaaaccattacgctcaccattgtctgcattataatcggagcggcggcgctatcgttattcacggcgaatgtgctcggcattccgctgtcgacgagtgaggtcactgtcggggcgattgtcggtgtcggcgtcgcgtacaaagtattgtttttacagcatcttttggtcatcgtgattttttgggtgctcgtaccgttcgtcgcgttctgtttcacttttctcgtatcgaaggtattcagttctctgaatattcgagtcatttcgaaacggaaacagaagattttagggattgtgctgctttttgcggggttttgggaagctttttcagccggaatgaacaatgtcgcaaatgcggtgggccctttggtggcagcgggcgtactcagcgtgtcaaaaggaacgctgtacggaggcatctttgtcgctctcggcgctctgcttttaggacgtaaagtgcttgaaaccaacgggaaaaagattacgaggttttcagccggagaaggcatactgctttcaggaaccggcgcggggcttgtcattatcagttccgtcttcggtctgccggtcccattggcgcaagtcacatcatcatcaattatcggtatcggaatggccaaaaacgggccgaacgtttttcataaagaagtcgtgaaaacgatgctcaaagtttgggtcgtttcaccgtttttgtcactgtcgatttcgtatctgcttgtttccctgctgttaaaaggagattattattccatctttatgatggccagcgtacttttggcagctggcggagccgccagtctgatgaaagccatccgaaaagagaaacgctctgtccatgaacaaggcgggggcatttaactattaatctgagtttatttatctgttaactgggaggaatcatgtattatgagtttagcaccgcacggaggaacattaattaatcgggtgaatgagcagtatgatcttacatccgtccacaaagaaattgagcttgatttgatttcgttcgctgatttagagctgatcgggatcggggggtacagcccgattgaaggatttttcacagaaaaagattacgtatcagtcgttgaaaatatgcgtctggcatcaggggttgtctggtccctgccgatcacgcttccggtcgattcagaaaaagcggctgagcttgccgtcggcgacacggtgaaactgacttacggcggagaaacatacggcgtcgtcgacatcgaagatatttatacgccggataaacaaaaagaagccgttcacgtatataaaaccgatgatgccgcgcatccgggcgtgaaaaaattattttcacgcggcgatacgtatgtcggcgggccgatcacattaattaaaaaagcgtcaaagcagtttcctgagtttacatttgaacctgccgatacaagacgaagcttcgaagaaaagggctggaaaaccatcgtcggtttccaaacgagaaatccggtccaccgcgcccacgaatatatccaaaaaaccgcgcttgagacggttgacggcctgtttttgaacccgctcgtcggtgaaacaaaatcagatgacattccggcggatgtcagaatggaaagctaccaagtgcttctcgatcattattatccgaaagaccgcgttttcctcggcgtgtttttggcggctatgcggtatgcggggccgagagaagccattttccacgcgcttgtccgcaaaaactacggctgcacgcattttattgtcggccgcgatcatgccggcgtcggtgattactacggcacatatgaagcgcaagagctgtttgatcaatttacagcggatgaactcgggattacaccgatgaaattcgagcacagcttcttctgccagaaatgcggcaacatgggaacggccaaaacatgccctcatgacagagaagaccacgtcattctgtcaggaacaaaggtcagagaaatgctgcgaagcggcgtcatgccgccggcggaattcagccgtcctgaagttgtcgaggtgttgattaaagggctgaaaacgaaagaagaagcaggcgtttcttaaggaggaaaatagagtgacaaatcgtgatatcgtatggcatgaagcctcaataacgaaagaagaataccagcagaaaaacaagcataaaagctctatcctctggctgacgggcttaagcggttcagggaaatccacaattgcaaacgccgcagcgcgcgagttgtttgaacagggctatcaagtcattgtgcttgatggtgataacatccgccacggcttaaacaaggacttaggtttttccgatgatgaccgcaaggaaaatatacgccgcatcggggaagtggcgaagcttttcgttcagcagggaaccatcgtcatcacggcttttatttctcccttccgtgaggacagagatcaggtgagagagcttgtggcagagggcgaatttaatgaaatctacgtgaaatgcgacctcgatatatgtgaaaagcgcgatccgaaaggtttatataaaaaagcaagaaatggtgaaattccgttctttacggggatcgactcaccgtatgaagagccgaaagcgcctgagctcgtacttgattcaggcaaatttgaacgtgaagaatgcaccggaagactggttgactttgtgaaaaacagcttagcataataggtccaaaaaggccgcgcaatcagccggatatcccccgcaatggcgggatatggtaaaatagctgaagtgcggcctcgcggctgttctgggaagatttcaaaacggatcggggagacatgctatggggaaagtatttatcgttggagccggtccgggagatccggacttattaacggtgaaggcaatgaaagccatacagaaagcggacgttatattatatgacagattggtaagcaaagagattttacagtacgccggagaagaagcggatctgatttactgcggcaagctcccggattttcacattatgaaacaggatacgatcaaccgtttccttgtgaagtatgcgaaaaaggggaaaaccgttgtaaggctcaaggggggcgacccgtttgttttcggccgcggaggcgaagaagcggaggctctcgcacaaaacgccattccgtttgagatcgttcccggcattacatcaggaatcgcggctgctgcttatgccggcattccggtgacgcacagagaggcgagctccaatgttgcattcgttacggggcattataaacaagaagacgactttgaagaaaaatggaaagcgctggcgacgggcattgatacgctggtgatttatatgggaattaaaaatatccggcagattgaaagaatgctgctggaaaacggcagagacggcggcactccggcagcctttattcattggggaacgacggacaggcaaaaaacagtcgtctgcaccgtcggcacgctttcagatacagtgataaaagaagaaatcaaaaacccgagcttaattgttatcggtgatgtcgtcaattatcactgcaaactggactggtatgcatctgaacagaaaaatccggatttgagcgaggcgttgtaaatgaagcaggcgattttatacatcgggcacggaagcaggcttaaaaaagcgcagacagagtcggcggcgtttttaaaagggtgtctgccgcacgctgacgctcccattcaggaaatctgttttttagaactgcaggaaccgtctattgaagcgggttttgaagcttgtgtcagacaaggcgccactcatattgcggccgtgcctttgctgctgttgaccgctgcccacgcaaaacatgacattccggctgaaatcgaccgtgcggcggccctgcatcccggtataaaagtgacatatggtgttccgatcggagtggacgatgaagtcgtaaaagcggtccatcatcgcattgaagataccggagtgcccattgagcaggcgaaagtggtgctgatcggaagaggaagcacagatccggccgttaaaaacgcagtcagtgagattgccggaaaacttgaggcgattacacctgttaaagaagtcatcccttgttttttaacagcatgtgacccgcactataaagaagtgtttgccggccttgaagaggatgacggagcacccgtttttatcgttccatatcttctgtttaccgggcttttaatgaccgagattgaacgggaagttcaaaagcttcaaacgatcaatcaaaatgttcatctcgcttcatacttaggttttcacccgcatattaagcaggcgtttttgaaccgtgtgacagaagctgtccgaaaccccggcggtcagtttgattttaaggggggacagtatgctgcctctgcacattaatttaagcggaaaaagaattatcatcgcgggcggaggcaatgttgccttaagaaggctcaaaacagtgcttccggaaggcgcggatattactgtaatcagtcccgaggccctgcctgaaattaaacagctggcagatgaaggacgtatccgctgggtttcccgtaaaattgaaatgaaggatctcgcgcccgcttttttcatcattgccgcgacaaatgaccgcagcgtgaatcgggagatagccgcgggcgcttctgaaacgcagctggtcaattgtgtaagcgaggctgaacggggcagcgtgtatatgccgaagatcatccgcaaagggcgcattcaagtatccgtatcaacaagcggcgcaagcccggcacatacgaaaagactggctgaggacataaagcctctcattactgctgatttggctgaagaagtggatcaattatttgagaaaagaagaagatcataaaaaacaccttgtctgtcatcaggcagggtgttttttatactgtcctgacagtccgccgaatgtgaaaaattcaaaacgaaagcggtcaggattgcgaagtgatgaggaatatgtatgtgatcccgatgccgcctggattccgcccgcatacaaaggaaaggtcagagacccgcccggatgtgctcaggttcggagagggaaggtgaaagtatccgccgccaaatcaggtgtgaccgttttaatcacagacggcccggcggatcaggcagacatgacgggaaactgatcagatattgtaaagatgattctgacggctgggagagtttcgtctccgtttatacgtaataaaaaacacctccaagctgagcgcgggtttcagcttggaggtgcgtttattttttcagccgtatgacaaggtcggcatcaggtgtgacaaatacggtatgctggctgtcataggtgacaaatccgggctttgcgccgtttggctttttcacgtgtctgatttttgtataatcaaccggaacggagccggaatctttcgctttggaaaaataagcggcgatcgcagccgcctccagtatggattgttcatccggatcgctgcttttaatcacaacgtgggaacccggaatgtctttcgtgtggaaccataaatcatcccttgcggcagcttttgtcgttaagtactcattttgtttattgtttttgccgacaagaatcgtcaatccctgtgaagattcatattgctccaaaacaggaacgtgctgcttctgttttttctgtcctctctgctgtttcggccgcagatatttgccttccacaagctcttcccttatttcgtgaatatcctttgtggaggcggaggagagctgctggatcagctgatcgaaataagcgatttcctcctcggccagacggatctgttcttttaccacctcgacggaattcttcgccttttgatactttgtaaaatacatctgtgcattttctgacggtgttttgttcggatttaaagggatggtcaccgtcttactttcttcatcataataattgatgacttccgcttctttgtcaccttttttcagcatatacaaattcgccgtcagcagttcgccgtatagctggaattccttcgcattctctgagtagtcgagcgtcttttccagcttttttatcttattggcgttttttttccgttcatttgcgacaaaccgctcgagatcctgcgcctgctgtttgacgcggtcgcgttccgctttgccgaaataaaaccggtccaacagctcactcagtgagtgaaaggtgcgctcctctccgtttacatgtgtgagagacaggagataaaagtattcctttccgccggctgtcgtaatgttcggtgtaaacctgcaatctttcacggcatggaacatttcaagcagcgtcttcggcagcgttattttgttagcgagacccgctctgtgaacggcttcttttgcaaacagcggagaaacaccggagaaatgtctgacgatctgctggtcaagccgtccttcctgaaaactgagataacgcaaaacgtcctcttcatccgcggcaagcggcgaaattttttcctgagcgggaggaagcttgtaatcatatcccggcagaacggtccggtagctgttcatcgacggagataaatgtttcagcccgtcgatgatggctccttctccgtcagtcagaataatattgctgtgccgtcccataatttcaacatacagcgttcttacggtttcgtcgccgatttcatttctgctttttatgcggaatatcataatccggtctaatccggcctgctctattttctcaataaatccgccttctatatgctttctgagcagcatacaaaacatcggcggctcgctcggattttcataggcctggtttgtcatgtgcacccgtgaatagctcgggtgcgccgacaataataatttgtggttttttccgttggcgcggatatggaatatcacatcgtgcttaaaaggctgatggactctcgtgatccggcctccggcaatccggctgtttaattcatgtgtcattccgtatgtaaacatgccatcaaaagacatataaaacaccctttccttcttcctgcattcgataattatagcatgaaaaggggcgagtcagaataagcttgtttacagagtgacatctctaaagcgaggcaggggagtggacgagaagaatgaagtttcatgaaatgggacaaaccgatttgctgaaagcaacaaatacgtccattaaacaggggttgaccgaaaaagaggtgaaaaaacgccttgaaaagcacggaccgaacgagcttcaggagggcaagaggacaccggcgatcgtcgtgtttttcgcccaatttaaagattttatggtgctcgtgctgctggcggcgaccttaatatccgggtttttaggcgaatatgtagatgccgtagcgattatggcgattgtatttgtcaatggggttctcggtttttttcaagagcggcgtgcggaaaagtcattacatgcactaaaagagctgtcaacgccgtatgtgtcagcgttgcgggacgggagctggaagaaaattcagtccaaggagctcgttcccggcgatatcatgaaattttcaagcggcgaccggattggcgcggatgtgcggatcgttgaagcgaaaagccttgaaattgaggaatcggcgctgaccggggaatcaattccggtggttaaacaagctgataaactgagaaagccggatgtttcgttaggcgacatcagcaatatggcgtttatgggtacgatcgtaacgcgcggcagcggtgtcggcgttgtcgtcggtacaggaatgaatacggcaatggggaaaatcgccgatatgctggaatccgccggcagcctttcaacaccgctgcagcgaagacttgaagagctcggcaaaattttaattatcgtcgcgctccttttaacggtattggtcgttgcagtcggcgtcttacagggacatgatctttacagcatgtttttggccggggtgtcattggccgtcgccgcgattccggaagggcttcccgccattgttacggtggcattatcaatcggcgtccagcgcatgatcaaacaaaaatcaattgtcagaaagctcccggcggttgaaacattgggctgcgcctctgtcatttgttctgataaaaccggcacgctgacacaaaacaaaatgaccgtcacccatatgtggtcaggcggcaaaatttataaagtgtcaggcatcggctatgagccggagggcgttttcacccgagatgagcgggaaatcaagccgaaagatgagaaaattcttgaacagatgctggttttcggcgcgttgtgcaacacatccgaaatcgcactgaaagacggccgttatgtactcgacggtgatccgacagaaggagcgctgctgacggcagcaagaaagggcggctattcaaacgattggctcagcgggcaataccgcgtggttgccgagtttccgtttgactccgtccgcaaaatgatgaccgtcattatagaggataaggaaaaaaagcagttcgtcatcactaaaggagcgcccgatgtgctgattgaccgctcgtcacatctgatgcacggcgcaagaagtacgcctttttcaggagaaaagaaagcagaaacggaagcggttctgaaagagctggcgtcgcaagctttgcgtacgattgcgattgcttataaaccgcttaaggccggagaaaagccgacaatggagcaggcggaaaaaaatctgacgatgctcggcttgtcaggcatgattgatccgccccgtccggaggtcagacaggccattaaagaatgccgtgaggccggcattaaaacggttatgatcacaggagatcacgtcgaaacggcaaaggccatcgcaaaagatttgcgtcttcttccgaaaaagggacgtgtgatggacggcaagacgctgaatgagcttacggagaaagaacttatcgaaacggtcgatgatgtctacgtcttcgcacgcgtgtcacctgaacataaattgaaaatcgtcaaagcgtttcaggaaaacggacacgtcgtcgccatgacgggagacggggttaatgacgcgccggccataaagcaggcagatatcggtgttgccatgggcgtgacgggaacggatgtggcaaaggaagcctcttctctcattctggtggatgataactttgctacgattaaatcagccataaaagagggacggaatatctatgaaaatataagaaaattcgtccggtatttgctcgcctccaacgtcggtgaaattttagtgatgctgtttgcgatgcttctcgctctgccgctgccgctcgttccgattcagatattgtgggtgaacttagtcactgacggactgccggcgatggccctcggtatggatcagccggaaggagacctgatgaggcggaagccgcggcatccgaaagaaggagtgtttgcgagaaaactgggctggaaagtcgtatcaagagggtttttaatcggagccgcaaccatttttgcgtttatcatcgtctatcaccgcaatcctgaaaatctgccctacgcacagaccgttgcattcgcgactcttgtcctggctcagcttatacacgtgtttgactgccggagcgaaacgtctgttttctcccggaatccgtttgaaaatatctatttgctcggcgccatcatttcttctatcttcctgatggtcatcgtcatctattatccgccgctgcagccgattttcaaaacagtgccgattacgccgggcgattggatgctgattatcgggatgtctggcatacctacttttttgctggcgggttcacttttgacaagaaaaaaataattccatatgatataatcttaggggtaatagcatgtctattgcccttttattttgataacgggaaagaattgggtgtttcatatgatacggagtatgacaggcttcggcagcgcaagcagcacaaaaggcgatctctcggcaaccgttgaattgaaatccgtcaattaccggttcaaagaagtgaacgcccgcctgccacggcctttgctatatgtagaggataagctgaaacaaacgatattgcagcatatacagcgcggaagagtagagctgtttctcactgtaaacagtgacgcgctcataaaaagaagcctgaacatcgattgggagctccttgatgaatatgtgagcgccgcacacgtcatgaaagagcgctacagcctggccgcagaacccgatgcaatggatttctttagatttgaacacattgcgcagattcacgaagaacagatgcgtgatgacaagcttgaagaagtcatcagggaagccgctgagctggctgtaaaggaactttgtgatatgagggaaaaagaaggccggcttttggcggaagactgctttctgcacattgagcggcttgagacgctgtccgaacaggtgaaagagcgcgcttcggccgttgttattcaataccgcgagcgtctttacgcccgaatgaaggaatggacggaggacgcgctcgacgaaagcaggctgatcacggaatgcgccattttcgccgatcgttctgatataacggaagaaattaccagattaaagagccattttgttcaattccgtgatatattaaaagaaggcggggcagtcggccgcaaacttgatttccttgttcaggagcttaaccgggaagcgaacacgatcggctcaaaagccaatgatcatcaaatcacaaagcttgtcgttgaaatgaaaagttctattgaaaaattgaaggaacaagtgcaaaatatagaatagcgactgtgcgtattgtttacagacggtctcttcaggttacactagagacgtctattttacagggggaacgtagaagatgacgattaaactgattaatatcggatttggcaatatcatctccgccaatcggatgatttcgattgtcagcccggagtctgcgccaataaagcgaatgatccaggatgcaagagaccgcggaatgctaatagacgctacatacggacgaagaacccgtgcagttgtcgtcatggatagtgatcacattatcttatctgccgtccagcctgagacagttgcacacagactttctgtgaaagaagaaattatggatgaagggcaggggtaattgccgcatgaaagaaagagggttattaatcgttctctcaggtccctccggagttggaaaaggaacggttcggcaagcaatattttcacaacaggacacgaaatttgaatactcaatttcagtcacgacgagaaacccgagagagggtgaggtcgacggcgtcgattatttctttaaatccagagaagaattcgaacgcatgattgaaaacaacaaactgcttgagtgggcagaatatgtcggcaactattacggaacgcccgttgattatgtcgaacagacgcttcaagaaggaaaagacgtcttcttagagattgaagtgcagggcgcgctccaagtgcggaatgcatttccggaaggcctgtttatcttcttagcgccgccgagtctttctgagctgaaaaacagaatcgtgacaagagggactgaaaccgacgatttaatcgaaaacagaatgaatgccgcaaaagctgaaatcgaaatgatggacgcgtatgattatgtcgttgaaaacgacgatatccaaacggcttgtgataagattaacgcaatcgttctcgccgagcacttaaaacgtgaacgcgtcgctccgagatataagaaaatgctggaggtagaataacttatgttagatccgtcaattgactctttaatgaataaattagattctaaatatacgctggtgactgtgtctgcaagacgcgcgcgtgaaatgcagatcaaaaaggaccagcagattgaacataccatttctcacaaatatgtaggcaaagctttagaagaaattgacgcgggcctgctttcgtttgaaagagaagacagcgaataacaagcacacgtagcaacctatctctacataggttgttatttttttccgtttgggatttgtccaatgctttcataaaggggagaagacttcatgaaaaaccgaaacattttgctatgcgtaagcgggggaattgccgtttataaagcttccgcactcacgagcaagctggttcaggccggcgcaaacgtcaaagtgattatgactgagtccgcgcgtgagtttgtttctccgctgacatttcaggcgctgagccggaatgaagtgtatacagatacatttaatgaacaaaatccgaaggtgatttctcatattgatgccgctgactgggcggatttaattattgtcgcgcccgctacggcaaatatcatcggcaagcttgccaacggaattgctgacgatatgctcacaacgacggtgctggcggctgaggccccggtctgggtggcgcctgcgatgaatgtccatatgtatgatcatccggcggtgaaacggaacatctctgtgctttatcaggacggggtccgctttatcgagccgagtgaaggctatttggcatgcggatatgtcggcaaaggaaggctggaggagccggagcttattgttgaacgtgtcagagagcattttaaggagcctgaagacgatgcgccgctgaaaggaaaacatattgtcattacggccggtccgacgcgcgaagccgtggaccctgtccgattcttcacaaataaatccaccggcaaaatgggctacgctgctgctgaagccgccgtccgtctcggggcgcgggtgacgctgatttcaggcccggtgtcaatagaggcaccagtcgggctgtatcagtttcttcctgtgcaatcggcagctgatatgagagaagccgtgctttctgtgtttgattcatgcgacatggtgattaagacggcggccgtggccgattttacgccggcggctgtttccgatcacaaaatgaagaagaaagacggttcgctcgtgatcgaattcaaccgtacagcagacatactgaaagaactcggcgaacggaaaacacaccagctgctggtcggatttgcggctgaaacgcaagacgtcgaacgctatgcgcgcagaaaactcgaacagaaaaaccttgatatgatcgttgcgaatgatgtgaaagcggaaggggccggatttggcacggatacgaatgtcgtcaccttctatttccgagacggaagaaaacgggagcttgcgcttatgtctaaacttgacgtttcctttgaaatgctgaaggaaatgaccgctttgaaagtcgaggaccgaaaacccgtatgaatgtagcagaagtcattgtcgatgtcagctccaaaaacattgacagaccctttgattacaaaattcccgatcatttaaaagggatgatcgaagtcggcatgcgggtgattgtcccgtttggcccgcgcaagcttcaaggatttgtgaccggtttgaaagattcgtccgaattaaacggcggctcaatgaaggaagtcgagaagcttcttgatttgacgccagttctgactgaggaactgatgcagctgtcttcatggctttctgacaaaacgctgtcgtttaaaatcacggcgcttcaggcaatgctgcccgccgcactgaaggcgaagtacgagaaagagctgaaagtcgttgacgaagcagcgctgaccccggacatcaaacagcttttcaggaatcaaaaaagtcttctgtactcggatattaccgatgaaagcattctttcgtcacttcagaaattcgtgcgcaaaggaagcattgatgtcacatataaagtcgcccaaaaaacgaataaaaaaatgatccgcatgatcgaagcgggggcagacaaagaagaactcgcccggcacgcagattcattgacaaagcaggcttctaaacagctcgccgtgcttacttattttatcggcgggggagaaaagatttccgcggctgaactttgcaaaaagaccgattccagttccgcgacgctgaaaacgcttcttaaaaaggggcttcttacggaaagctttgaggaggtttaccgcgatccttatcaggacagaatgttcaaaaaaacagagccgctctctcttacagaagagcagcaggccgcttttgagccgattaaacaagccgtagccgatcatgtccaccacgtctttctgcttcacggcgtcacgggaagcggcaaaacggaaatttacctgcaatccattgaaaaagtgctggcaaaaggacaagaagcgatcgtgctcgttccggaaatctcgttgacaccgcaaatggtgaaccgttttaaaggccgcttcggctcacaggttgcggtcatgcacagcggattatccacaggtgaaaaatacgatgaatggcggaagattcagcgcaaggaagtccggcttgtcgtcggagccagatcggccatctttgccccgtttgaaaatctcggcatgatcattattgatgaagagcacgaatcttcctataagcaggaggaaatgccgcggtatcatgcaaaggatgtagccatccgccgggccgagcatcacagctgtccggtcgtcctcgggagcgccacgccgacattggagtcatttgcgcgggcgaaaaaaggcgtttatgagctgcttccgttaaaacatcgcgtaaaccgccagctcatgcctgacgtttctctcgttgatatgagagaagaactgagaaatggcaacagatcaatgttttcaagagagctgatggaacagctggaagagaagcttgcaaaaaaagagcaggccgtcctttttctgaataaacgggggtattcctcgtttgtgatgtgccgggactgcggttatgtgccgcaatgtccgcattgcgacatttccatgacttatcaccgctacggacaaaggctgaaatgccattactgcggccatgaggaacctgtcccgggaacatgcccggaatgcggcagcgaacatatccgctttttcggcacgggcacgcagcgtgtggaggaggagcttaccaaagtgctgcctcaggcgcgtgtgatcaggatggatgtggataccacttcaagaaaaggcgcccatgaaaaattgttgtcagcgttcggtgaagggaaggcggatatcctgctcggtacgcagatgatcgcaaaagggcttgattttccgaacgtgacgcttgtcggagtattaagcgcagatacgacgcttcacatcccagatttcagggccgcggagaagacattccagctgctgacgcaggtaagcggacgggccgggcggcatgaaaagccgggaacggtggtcattcaaacgtatacaccgtctcattacagcattcagctgacgaaaacgcacgactatgaaactttttttcagcaggaaatggcgcacagacgggcccagtcatacccgccgtattattacgtggcgctggtgaccgtttctcatgaagaagcggcaaaagccgcggtcaccgcagaaaagattacaaactatttaagagcgggatgcgggcctgatacgaaaattcttgggccggcggcttccccgattgccaggatcaaagatagatatcgctatcaatgcgtgataaaatacagacaggaaaacgagttgcagattcagttgaaaaagatactggagcactataaacgcgacattgcgcaaaagcatgtaatgatttcaatcgatatgaatccgtacatgctgatgtaacattagtttttggagggcaaaattttggctgtaaaaaaaatcgtcacacacccggcggaggttctggaaacacccgccgatgaagtgacagtgtttgataaaaaattaaaaaaactgcttgacgatatgtacgatacgatgctcgaaatggatggcgtcggtctcgccgcgccgcaaatcggcattttaaaaagagcggccgtcgtggacatcggtgaagaaagcggccggatcgaccttgtaaatccggttattcttgaaaagagcggtgaacagaccggagtcgagggctgcttaagttttcccggggttttcggtgatgtcacccgcccggattacgtaaaggtaaaagcccacgaccgtaaaggaaaaccgtttattttagaagcggagggttttttggccagagccgttcagcatgaaatggatcatttagacggcattttattcacatcaaaaattacggcttactacactgaagaagaactggcagaaatggaaggatgattggatgacaaggatcgtttttatgggaacgcccgacttttcagttcccgtcctgcgcacgcttattgaagacgggtatgaagtggttggtgtcgttacgcagcctgaccgcccgaaaggcagaaagaaaatcatgacgccccctcctgtaaaggctgaagctgaacgtcacggcattcccgtgcttcagcccgaaaaagtaaggctcgaagaagaaatagaaaaagtgctcagcctgaagccgggcctgattgttacggcggcattcggacagatcctgcccaagcagctgctggacggcccgacatacggctgtatcaacgtacacgcgtcactattgcctgaattaagaggcggagcgccgatacattattcgattctccaaggcaagaagaaaacaggcgtgacgatcatgtatatggttgaaaagcttgatgcgggcgatatgatttctaaaatcgaagtggaaattgatgaaacggataacgtcggcacgctgcacgacaaattaagcatagcaggggcaaagcttttgtcagagaccgtcccgaacgtcatttctggaaatattaaaccgatcaaacaggacgaatcaaaagcgacttacgcgcctaacattaagcgtgagcaggagcggattgattgggcaaagcccggagaagagatctacaaccagatcagaggtttaaacccttggcctgtcgcctatacaactttgaacggtcaaactattaaagtatgggcttctgaaaaagttgctgcaaaaactgatgctgcgcccggaacagtcatccgcacggagcaaaacggcattgtcgtcgcatcaggaaacagcaccgcccttttaatcactgagctgcagccggcgggaaaaaaacggatgaagggcgaagattttgcaagaggcaaaaatgtgcagtccggtgacgtgttaggagcagcaaatgaagaaaattaatgtccgggagctcgcccttgaagcgcttgagaagcttgagcaaaatcaggcatacagcaacctgcttcttacatctgttatcaaaacgaacacgctcagcgatcaggacagaggactgctgacagagcttgtctacggaacgctgcaaaataaaatcgccttagactatatgctgaagccttttatccgcaagccgaataaggtgaagccgtgggtgattcagctgcttcgtctgtccgcgtatcaaatggagtatttagaaaaaattccggatcgcgccgccatccatgaagcggttgaaatcgccaaaaaacgcgggcataagggcattgcgtcctttgtcaacggcattctccgctccctgcagcgtgagggggcgccgtcattcgctgaaattgaagacccggttctccgtctttctacagagacaagccatcccgaatggctcgtaaaagagtgggtcgaggcgtacggctttgaggcggctgaaaagatctgccggattcatctcattccgccgaagcagacgctccgtgtcaatcacataaagagcgacagggaaacggtgctgaatgagatggagaatgccggtctggaagcggaagccggagacctttctcctgatgcgattaagcttttgaaaggaagcatcgcgaacacggcatttttccaaaacggccgggtatccatacaggatgaaagctcaatgcttgtcgcgcgggcgctggacccgaagccgggcgaaaccgttttagatgcatgcgccgcaccgggcggaaagtcggctcacattgcggaactgatggagaacgaggggagcctcacatcgcttgatcttcaccgccataaagtgaagctgattaaagagggcgcagaacggctcggacttacgatcatcgacgcgcaaacgatggatgcgcgaaaagcgggagaggcctttggagcagaacggtttgaccgtattctcgttgatgcgccttgctcaggtttcggtgtcatcagaagaaaacccgatatgaaatatacgaagacgccggaggacagcagacggctgtcagaaatccagctcggcattttaagggaaatcgccccattagtaaaaaaaggtggcacactcgtatacagtacgtgtacaatggatcggacagaaaatgaagaagttatgcatgcgtttatacaagaacaccctgagtttgaacccgatttgtctcttgaaaagcggctgcctgaaaaggcgagaccctttgttcaggatggaagccttcaaattcttccgcattatttcggaacagacggtttctttattagcagcatgagaaagaagggataaaaaatgacacaattaaaaaagacaagcgtacggaaagagctgcggactgagcagccgtccatttactcttttgaattagatgaaatcaaacaatggctgaccgagaatggcgaaaagccgttccgcgcagcacagatttttgaatggctctatgaaaagcgggtttcttcatttgatgaaatgacaaacctctcaaaaagcctgcgtgaaaaactcgagagcaattttgtgctgacaacgctgaaaacggctgtaaaacagacatctcaagacggcacgatgaaatttttatttgagcttcatgacggttatacgattgaaacggttttaatgagacacgagtatggtaattctgtatgtgtaacgacacaggtcggctgccggatcggctgcacattttgcgcgtcaacgctcggcggtctgaaacggaatcttgaagcgggagaaatcgtcgctcaagtcgtgaaagtgcaaaaggcgcttgatgaaacggatgaacgcgtcagctcagtcgtcatcatgggaatcggagagccgtttgataatttcaatgaaatgctcgctttcttaaaaattattaaccacgataaagggctgaacatcggagcgcgtcatatcacagtttccaccagcggaatcattccgaagatttacgatttcgccgatcaaaaaatgcagatcaatttcgcgatttctctgcatgctccgaatacggaaatcagaagccgtctgatgccgattaacaaagcctataagcttcctgaccttatggaggccgtcaaatattacatcgagaaaacaggcagacggatcagctttgaatacgggctgttcggcggcgtaaatgatcaggtcgaacatgcagaagagcttgcagaactgttaaaagacgtgaaatgccatgtcaatttaattccggtaaactatgtgcctgaacgggattacgtccgtacaccgagagatcagatttttgcattcgaaaaaacgttaaaatcccgcggtgtaaatgtcacgatcagaagagagcaaggccatgacattgacgcggcctgcggtcagcttcgcgcgaaggagcgtcaagacgagacgaggtgaagaggttgattacagccttgaaaacagatacaggtaaagtccgccggcataatgaagatgcggcgggcattttcacaaaagaagacgcggtgcttgcggttgtcgccgacggcatgggcggtcatcttgccggagatgtagcgagcaggatggcggttgcggcgatggaagagcagtggaaccggaccgaaacggttccttctctgccgtccgcttgcgaggattggctgaaagaccggattcatgaggcgaatgtcaaagtacatgaccacgctaaagcgaatgaagaatgccggggaatgggcaccaccattgtctgcgccttattcacggggaagtttgtcactgtggctcatatcggagacagccggtgctacctgcttcaagagggggaattcactcagctgactgaggaccattcgcttgtgaatgagctggtcaagacgggggaaatttcgaaagaggacgccgagcaccatccgcggaaaaatgtattgacgagagcgctggggacagatgaaaccatcagccccgacgcccgttcttttgaactgtctgacggcgatcagctgcttttatgctctgacggactgtcaaataaaatagaagatcacgagatcaaacaaatgcttcaagccgaatctgatcctcaggaaaaagtagaccttctcatcagcaaagcgaatcaaaacggcggcgaagataacatcacggctgtgttgattgagttttccgcagatgaaaaagagggtgaagacaagtgctaaccggcaagcggatcagcgggcgttatcatatcctccggcccattggcggcggcggaatggcaaacgtttttttagctgaggacatcattctcgaacgtgaagtcgcaattaaaattctgcggtttgactttgtgaatgacattgattttatcaggcgtttcagaagagaagcacagtcggcatcaagcctcgatcatccgaatatcgtcagtatttacgatatcggggaggaaggcgatatttattacattgtcatggaatatgtggaaggcatgacattaaaggaatacataaccgcacacggaccgctccatccgaaagaagcgctgtccgttatggagcagatcgtctcggccatcgcccatgcccatcaaaaccatatcgtgcaccgggatattaaaccgcacaatatattgatagatcatttagggcatatcaaggtgacggatttcggcatcgccacagcacttacatctacgacaatcacacatacgaattctgtgctgggctcggttcattatttgtctccggagcaggcgagaggcggcctggcaacgaaaaaatcagatatttacgcgctcggcatcgtgctgtttgagcttttaacaggcaaaatcccttttgacggagaatcagccgtcagcatagcgctaaagcacctgcaaacagaaacgccttccgccagaaagtggaacccttccattccgcagagcgttgaaaacattattttaaaggcaaccgctaaagatccgtttcaccgctatgaaagcgccgaagacatggaggcggacatcagaacggcttttgacgccggcaggctgaatgaacaaaaattttccgtgcaggatgatgaggaaatgacaaaagccattcccgttattactgacggcgcaaaagccgctcctcaggcggaaacgccgggggagacggatgataaggaacagcagccagccaaaaagaaaaaacggaaatggccgtgggttttgctggccgtctgtttcattttcattatggcggctgttcttgcggtcaccgtgttcccgtctttatttatgcctaaagatgtaagcgtccccgacgtacggggcatgaagtacgaaaaagcggaagccctgcttgaaaagaacgggctccgggctgatcctgatataacggacattgaagatgaaaaaatagaagaggaattaatggtcaaaacggacccaaaagcggggtctaccgttaaagaaggttcttctgtaaaactgtacaaaagcatcggaaaaccgaaaacccagctgatcgacgtgaaaggacggcagatcggcgacgcaaaaaaagcgctgaaggaaaaaggcttcaaacatgttaatgtaaaagaagaaaacgatgacagcgaggccggcaccgtaattgatcaggacccgtcagccggcaccgatatggtcgcaagcgacgatgaagtcaatctaacggtcagcctcggcccggcggacgttacgctgagggacttaaagacttacagcaaagaagcggcttcagggtatcttgaagataacggcctgcagcttgttgaaaaacaagcccattcagatgacgtgccggaaggacaagtcatgaaacaagagccgtcagccggcactgcggttaagccgggaagtaatgttgaagtgacgttctcgctcggacctgaagaaaaaccggcgaaaacggtaaaagaaaaaatcagcattccttacgaacctgaacatgaaggggacgagcttgaagtgcaaatcgccatcgatgataaggaccacagcatctctgatacgtatgactcatttaaaataaaagagccgactgaaaaaacaattgaactgaagattgatcagggacagaaggggtattatcaagtgatggtcgatcataaagtggtcagctacaaaacgattgaatacccgaaagataatgactgacaaggagggaccctatgcctgagggcaaaattataaaagcgttaagcggattctattatgtcttggatgaatcacaggacaagatcattcaatgcaggggccggggcattttcagaaaaaataaaataacgcccctggtcggcgattatgccgtttatcaggctgaaaatgataaagaaggctacctgctggaaatcaaagaacgaacaaatgagctgatcaggccgccgatttcaaatgtcgatcaggccgttctcgtcttttctgccgttcagccggcgttcagcacgtctttattggaccgttttctcgtccttgtggaagccaacggcattcacccgatcatctgcataaccaaaatggacttagctgcagacggggaatcgaaagaggcgatactttcttacgtgaaagactatcaggcgatcggttatgacgtatatgtgacgtcatcaaaagaaaacagcggcttaacaggcattgtgaaacacttcgagaacaaaacgacggtgtttgccggtcagtcgggagtcggaaaatcttcgcttttaaatgcgatcagcccggagcttgagctgaaaacaaacgagatttccgcgcatttgggacgcggaaaacatacgacgcgccatgtggagctcattcatacatcaggcggtctggttgcggatactccggggttcagttcgcttgaatttaccggcattgaggaagaagagctgggcagcacgttccctgagatcagagaaataagcgcctcttgcaaattcagaggctgtctgcatcttaaagaaccgaaatgcgcggtaaagcaagcggtggaagaaggagagattcagccgtaccgctatgagcattacaaagaatttatgcaggaaataaaagagagaaagccgaggtattaatatgattaaggttgcgccatcaattctttccgccgattttgcttcactgggcgaggaaattaaagacgtggaaaaaggaggggcggactatatccatattgatgtcatggatggccatttcgtccctaacattacaatcgggccgcttatcgttgaagccgtccgtccggtgactgatctgccgctggatgtccatcttatgattgaaaacccggaccgctacatcccggcattcgcaaaagccggtgcggacatcctttccgttcacgctgaagcgtgtccgcatcttcaccggactattcaattgataaaagagcaaggggtaaaagcgggagttgtgcttaatccgcatacgcccgtccaaatgattgaacatgtgatcgaggagcttgaccttgtgctgttaatgacggttaaccccggttttggcggacagcgcttcattcattcggttctgccgaaaatccgtcaggtcaaacagctggctgaggagaaaggcctgtctgagcttttaatcgaggtggacggaggcgttaataaagaaacagcccctttatgcgctgaagcgggcgccaatctgcttgttgccgggtctgccgtatataatcagccggatcggaaaaaagccatcgccgacatccgaaacgcatcataaacatgctgaaaaagagcccggtgaaagccgccggctcttttcgcgtctaagagagaggatagcatatgaagacaatcaatatcgttgcgggcggcccgcgggagcttattcccgatctatccgaatacacagacggagatacgacgtgggtcggagttgataaagggacggttgctcttttggaggccggaatcattccgcaggaagctttcggtgattttgacagcattacggaagaggagctcatgcagattcaaaaagcggcgccggccctccatgtgtatcaggcggaaaaagattataccgatcttgaactcgctcttgactgggctttacaaaaagaaccggaaaacattcgggtattcggtgtgacgggcggaagagccgatcactttttagggaacatccagctgctgtataaagccttacataagcataccgatgtcgagctgatcgaccggcagaatgacattcagatgttcgggcccggccgttatacaattgaaaaaaaagcgcgcagacgctatatttctttcattccgtttacggaagcggcagacggcctgacactcgacggttttaaatatccccttgataattgtcatattcctctgggttccacactatgtattagtaacgaactcattcattcacgaggtactttttcgtttgcaaaaggcatattaataatggtaaggagcgcggattagaaaagcggcttctgccatatgcggaaaaaaccatgaatcctaaagtgatgaacgcagcggatacgggacttataggaggggacaaaatgaaattttataccattaaattgccgaagtttttaggaggaattgtccgggcgatgctgggctcatttagaaaagagtaagcccaagaagctgaaattgccctctttgaacgcataaaaaacgcctgccgcataaaagggcaggcgttcatttttgcttatacacgctcaactttaccggattttaaagcccgggcagatacatacacttttttaggtttgccgtcaacgaggatgcggaccttttgaaggttggcgccccaagtacgcttagaagcgttcattgcgtgagaacggttgtttccggcttttgtttttttacctgtaataaaacatttacgtgccatttgtttccctcctaactgcgcgaaacatctttttaaacatagtgtctcagatgctttcgttatacaatactttaaataatttaccacagctaaaaaccgtttgcaactattgtttcccttactttcaagaaaaatcacttgacatgtaaaaccaatcacatttccgcgctgaaggccgctgtctgtatcttttcttttcataatgggatacatatagtagaataatgataactctatgcatctgaaggaggaacctgtgtgtccattgaaatgaagacaaaatacggacagattgatatatccaacgaagtcatcgcaatggttgccggaggcgctgccattgactgttacggaatagtggggatggcctcaaaaaaccagattaaagacggtttgtctgaaatcctccggagagagaacttcgcaaaaggcgtacatgtccgtcaggaagccgaacaaatacatatcgacatgtacattattgtcagctacggcactaaaatatccgaagtagcccacaatgttcagacgaaggtaaaatacacagtaaatcaaacaatcggacttgcagttgattctgtaaatatttatgtccaaggcgtacgagtaacgaacccgtagtgaggaggatgagtattgtctagacgaaacttagatgggagagcttttgcggcaatgattctggcgggggctgagacattgtctcaaaatgcatccgcggtggatgcgctgaacgtgtttcccgtgcctgacggcgataccggaacaaatatgaatttatcgatgtcatccggtgcaagagaggtagagcacattgactcacccgacatcggcaaagtcggcatcgccctgtcaaaaggcctgcttatgggagcgagaggaaactcaggggtgatcttgtcccaattgttcagaggtttcacaaagagcattgaaaacaaaaaccaaatagatgcccgagagtttgccgcagcactccaagcgggagtggatatggcatataaggcggttatgaaaccggttgaaggaacgattttaaccgtggccaaggatgcggctaaaaaagcggtcgcctcggccaaagaagaaaccgatattatttcggtcatggaggccgttattgaagaagcggaagcgtcgctcaaccgcacgccggatctgcttcctgttttaaaggacgtcggtgtcgttgacagcggcggaaaaggtctgctttgtgtatatgaaggctttttggctgctttaaaaggagaggccgtaccgaaaaaagcggttcttccggcactcgatgatatggtgaatgccgagcatcataaaagcgcgcagagcatgctgagtacagaagacattgaattcggattttgtacggaagtgatggtgaggctggatcaagataaacggacgttcaaggaagaggcgttcagaaacgaactgagccgtttcggcgattcattgctggtcgtggctgatgatacgctggcgaaagttcatattcatgccgaagaaccagggaacgtactcaatctcgcacagcgttacggcgatttgattaaaattaaaattgaaaacatgagggaacagcatacttcaatcatcagccaagaacatgatgaaaaaaagccggccggcgttatgaaagaagcccgcaagccttttggcatcgtgactgtggcaatgggagagggcatttctgaattgtttacgagcatcggcgcttcacacgtaatcgaaggcggccagacaatgaatccgagcacggaagatattgttgaagccgttcagtctgtcaatgcggagacggttttcattcttccgaacaattccaatattgtgatggctgccaatcaggcggcgagcgtggctgaagaaaatgtcattgtcattccggcaaaaacggtccctcaaggcatgaccgccctgcttgcgtttaaccctgaccagccggctgatgtaaatgaagccaatatgcttgaggccatccggaatgtgaaaagcggccaggtgacatattcagtcagagacacccatattgacggcaaagatattaaaaaaggtgattttatcggcattttaaacagttcaattatcggcagcgccgaagatcggataagtgcggcgaaattgctgctggatgaaatgatcggggaagaagatgaaatcgtcaccatcctgtacggagaggacgcgccggaagaagaagctgagaaactcgctgagtatattgctagcgtctgtgaagatatcgaggttgaaatccataacggcagacagcctctgtatccatatatatttgcggcagaatagaagggcttatcaggcccttctattcttatgcctttatttacctgcggcagtgcggcagtgtgcctgcttgccaattgagaaatgttcaattagtctaaagaaaagcgctgaatgaagtgatgttaaggaggagcaaaccagcatgaagtatagaagcgtttttgatattatcggcccggtcatgatcggtccgtccagttcacataccgcaggcgccgcccggatcggcagagtggccagaagcttattcaggcgggagccccgccggatcgttgtgtctttttacggatcatttgcagaaacgtataagggtcacggcactgatgtcgcgattatcggcggcctgcttgattttgatacatttgatgaacggattaaaacagcgattcaaattgcggaagagaagggcatatatgtagagttccgtacagaggatgccgtgcccgttcatccgaatacggcgcgtatcgtcatttctgatgatgagggagagcttgcccttaccggtatttccatcggcggcggaaaaatagaaatcacggagctcaacggctttgagctgcgactttccggaaaccacccggctattttagtcgttcataatgataaattcggcacgattgcaggcgttgccaatgtgcttgcgaaattctccatcaacgtcgggcatatggaagtggcgcgtaaggacgtcggccagcttgcgctgatgacgattgaggtcgatcagaatattgaagaagaagtgcttgacgaactttcaacacttcctaatattatacaggttactaagatagctgactaaaaagtcaggaggaaaatgacatgtttcgtaatgtaaaagaattaatagaaatcactcaagaaaaacaaattccgatttcggaagtgatgatcacccaagagatggaagtgacgcaaaaaacacgggaagaaatctttcaaggaatggagcgcaatctctccgtcatggaagcagctgttgaaaaagggctgaagggcgtcacgagtcagaccggtttaacaggcggagatgccgtgaaacttcaggcatacatccaatcgggaagaagcctgtcgggcaatctgattttagacgccgtttctaaagctgtggcgacaaatgaagtcaatgcggcgatgggaacgatctgcgctacaccgaccgccggctctgccggggttgtgccgggaacgttattcgccgtaaagcataagctgaaccctacgacagaacaaatgatccgttttctgtttacagccggcgcgttcggttttgtcgtagcaaataatgcgagtatttcaggagcggcaggaggctgtcaggcggaagtcgggtcagcatcaggcatggcagcggctgcgattgtggaaatggcgggcggaacgcctcagcaatcagcggaagcaatggcgattacactgaaaaatatgctcggtctcgtatgtgacccggtcgccggattggtagaagtgccgtgtgtcaaacgaaacgcaatgggagcatccaacgcgatgatcgcggcggatatggcgctggccgggattacaagccgcattccttgcgatgaggtgattgacgcgatgtacaaaatcggccagacgatgccgacagcactgcgtgaaacgggacaaggcggtttagctgcgacaccgacgggaagagaattagagaaaaaaattttcggaggagcgctgaaatcaagtgacacaccatcagcaaactagtatagcggaaattaagggcattgggccggaaacagaaaaaacattgcacgaacttggtatctatgacatttctgatcttctgaattatttcccttaccgttatgacgactatgagctgagggatttagaagaagtaaaacatgaagaaagagtgacggtagaagggaaggttcattcagaaccttctcttacctattacggcaaaaaacgaaacaggctgacattcagggtgcttgtcggcaattatttaattaccgcggtctgctttaaccgtccctacttaaaaaagaaactgacgttaggttctatcgtcacgatatccgggaaatgggataaacacagacagaccgtttccgtgcaggaattaaaaactggtcctcatcaagaagataaaagcattgagcctgtttattccgttaaagaaaacgtcaccgtaaaaatgatgagacggtttattaaggaagcgctgcagcatcatttggacagtgcagccgatccgcttcctgaaaaattgagaatccgctataagctgcctgattacaaacatgccctgcagacgatgcatcagcctgaaacgagggaatcgttacagcaggcaagacgccggtttgtttacgaggaattcttattatttcagctgaaaatgcaggcgttccgtaaagcggaaagggaacagtcaaaaggcatcagccatgtgtttcctgctgaaaagctcgccgctttcacagacagcctgccgttttcactcacgaccgcacagacgcgcgtgcttcgggaaattaccgctgatatgacatccccttaccgaatgaaccgtctgctgcaaggtgatgtcggttcagggaaaacagccgtcgccgccatcgctttgtacgctgcgattctgtcggggtatcagggggcattaatggtgccgactgaaattctggccgaacagcatgcagattctctcgtatcgttgtttgcaaatgaagatgtaaatatcgcgcttttgacgagttctgtaaaaggaaagcggcgcagggagcttttggagcggcttgctctcggagagattgatattttagtagggacccatgctttaatccaggatgaagtggaattcaaagcgctgagtcttgttattacggacgagcagcaccggttcggggtcgaacagcgcaaaaaactcaagaataaaggtcaggatccggatgtgctgtttatgacagccaccccgataccgagaacgttggccattaccgtcttcggagaaatggatgtttccgtgatagatgaaatgcccgcggggcgaaaacaaatcgaaacgtattgggtgaaacacgacatgctggagcggattttggcttttatagaaaaagagctgaagcagggaaggcaagcctatattatctgcccgctcattgaagagtcggataaactggatgtacagaatgcgattgacgtatataacatgctgtctgacgtataccggggtaaatggaatgtcggcctgatgcacgggaagctccattctgatgaaaaagatcaggtgatgagagaattcagcgccaatcaatgtcaggtacttgtgtcaacaaccgtcgtagaagtcggggtgaacgtgccgaatgcgacgattatggtcatctatgacgccgaccgtttcggattatctcagctccatcagctccgcggccgggtcgggcggggagaccaccaatctttctgcatcttgatggccgatccgaaatccgaaaccgggaaggaacggatgagaatcatgtcagagacaaacgacggctttgagctgtctgaaaaggaccttgaactgcgcggccccggtgatttcttcggaaaaaaacagagcggtatgcccgagttcaaggtggcggatatggttcatgactacagagctttggaaacggcccgccaggatgcggtcaacctggtgtcttcagaggctttttggaaagatgacgaataccgcatgctgcgcggtcaattactttcaagcggcgtcctagaaggggagaaattaagctgattctgtaaaattcggcggctttcaaaaaacaatcattgcattccaatctatgagattatatactactattagtacctagtcttaattgtccggatggtgtttacagatgagaagaagcaagaaagaacgccaaaaattattgcagcagacgatcaaatcgacacccttcatcacagatgaagaattagcggggaaattcggcgtcagcattcagacgatccgtttagaccgcttagagctctcaataccggagctgagggaaagaattaaaaacgtggcagaacaaacgcttgatgatgaagtgaaatcattgtctttagacgaagtgatcggtgaaatcattgatctggagcttgacggccaggccatttccatattagaagtaagacgcgaacatgtcttcagccgcaatcaaattgcgcgggggcatcatttgtttgcgcaggcgaactcactcgccgtagccgtcattgatgatgagctggcgctgaccgcaagcgcaaatatccgctttacaagacaggtgaaagaaggcgagcgcgtcgttgcgaaagccaaagtgacggcagtcgaaaaagaaaaaggcagaacggtagttgaagtcaacagctatgtgggagaagaagtcgtgttctccggcagctttgacatgtaccgttcaaaacaatcataaaggtggagcatgcatgagaatagctgtagatgcaatgggaggcgacaacgcacccaaagctgttattgacggagtaatgaagagtattgaggcatttgacgatcttcatattacgctggtcggtgacaagacaacaatagaatcacacttgccaacaacatcagaccgcatcactgtgttgcacgccgatgaagtgattgaaccgacggatgaaccggtccgcgccgtacgcagaaagaaaaactcttctatggtgctgatggcgcaggaagtggctgaaaacagagcggacgcctgcatctcagcggggaatacaggcgcactcatgacagcgggactgtttattgtcggcagaattaaaggaatcgaccggcctgcgcttgcgccgacgcttccgaccgtttcaggcgacggtttccttcttttggacgtgggagccaatgtcgatgccaaaccggagcatctcgtccagtacggaattatgggatctgtatatgcccggcaggttctcggaatcagctcgccccgcgtcggcttgttaaatgtcggcacggaagaaaagaaaggaaacgacctgacaaaaaagacgtttgaattattaaaagaaacaaacgtgaattttgtcggaaacgttgaggcgagagacttgctcgaaggcgctgctgacgtcatcgtcacagacggctttacgggcaacgtcacgttgaaaacattggaaggttcagcgttatcgattttcaaaatgctgaaagatacactgacttcaagttttgtttctaagctcgcagcgggagtgctgaagccgaagctgatggaaatgaaactgaaaatggactattctgagtacggcggggcgagtcttttcggtttgaaagcgcccgtcattaaagcgcacggctcttctgacgcacgcgctgtttaccatgcgctgcgccaggcgagagaaatggtcagccaaaacgtggccgcatttatagaagaagaagtaaaagaagaaaaaacagatgagtagtctggaggttaccgcatcatgagtaagattgcatttttatttcccggacagggatcacaatatatcggtatgggaaaagacctgtacgaacgcgaagaaacgtcaaaacgtatttttgatgaagcggatgaaacgcttgaaacaaagctgagctcgctcatttttgaaggtgacgctgaagaattgacccttacatacaatgcgcagcccgcgctgttgacaacgagcatcgccgtattggaaaagtttaaagaatcaggcatcacccctgatttcaccgccggccacagcctcggagaatattcggcgcttgttgcggcgggagcgatgacatttaaagatgccgtttacacggtaagaaaacggggagaattcatgaatgaagccgtgccggccggagaaggcgccatggcagctattctcggaatggatgcggagtccttgaaaaaggtgacggatcaagtgacggaaaacggtcatctcgtacagcttgcaaacctgaactgccccggccagatcgtcatttccggaacggcaaaaggcgtggagctggcttcagaggaagcgaaaaacaacggagcaaaacgggcgatcccattagaagtaagcggaccgttccattctgaattaatgaagccggcagcgcaaaaactcgaggaggtgctcagcgcctgtgagttgaaaaatgcggctgttcccgtgatttcaaacgtttcggctgacgttatgacagaaaaagacgatatcaagaaaaaactgatcgaacagctgtattcgcctgttcgctttgaagaaaccattaacaaactgattgacgaaggcgtcacgacgtttgttgaaatcgggcccggaaaagtgctttcaggccttgtgaaaaaagtgaaccgccgccttaaaacaatcgcggtttctgaccatgaaaccatcgaactggcgattcaaacgctgaaggaggagaatcaggatgcttaatgaaaaaacagcagtggtaacgggggcgtcccgcggaatcgggcgggcgatcgcgcttgatcttgcgaaaaacggctgtaacgtagtagtcaactactccgggaatgaagcgaaagcgaacgaagtcgtagatgagatcaaatctttgggccgaaacgcgatcgcggtaaaagccgatgtatcaaattccgaagaagtacaaaacatgatgaaagaggctgtcgctgcattttcttcaatcgacattctcgtgaacaatgcggggatcaccaaagacaatcttctgatgagaatgaaagaaaatgaatgggatgatgtcatcaacattaacttaaaaggtgtattcaactgcacgaaagccgttacaagacagatgatgaaacagcgctccggccggattatcaacgtatcatcaatcgtcggcgtcagcggaaaccccggccaggcaaactatgtggcggcaaaagccggagtaatcggcttaacgaagtcatcagccaaagagcttgcgagccgaaatattacggtcaatgccattgctccgggctttatttccacggatatgacggacaagctttctaaagaagtccaagatgaaatgctgaagcagattccgctcgcgcgtttcggtgatccttccgatatcagcagcgttgttacgttccttgcttctgaaggatcgcgttatatgacgggccaaacccttcatattgacggcggaatggtgatgtaaagatttgtttttaaaatttcatcctagtttctctagttttttaaaaacgaatcctctataatacttgaggggaggtgaattgctatggcagatacattagagcgtgtaacgaaaatcatcgtagaccgccttggcgttgatgaagctgacgtcaaacttgaagcttctttcaaggaagacttaggtgctgattccctagatgtagttgagcttgttatggaacttgaagatgagtttgatatggagatttctgacgaagatgctgaaaagatcgcaacagtcggcgacgctgtgaactacatacaaaaccagcaataagctgatgctaaaagtcccgcctgacagcggggctttagccctttaatcgttcggttaccggcgtctgacgctgtacgcgctgccgattccgtttacggcggggagcgcggtgaacctgatgtgcctatggaggttactatgtcaaaacactcacattttaaagataaaaaaaagttctataaaaaaatagagcaatttaaagagttccaagaacggatttcggttcattttcaaaacgagaaacttttgtatcaagcatttacacattcatcttatgtgaatgagcatcggaaaaagccgtatgaagacaacgaaaggcttgaatttttaggtgacgctgttttggaactgacgatctcccaattcttatttgccaaatatccggccatgagtgaaggagatttgacgaagctgagagccgctatcgtatgcgagccgtcactcgtctcacttgcccacgaattgtcattcggcgatcttgttctcttgggaaaaggagaagaaatgacgggcggcagaaagcgtcctgcgcttttagcggatgtgtttgaagcgtttatcggcgcactgtatctggatcagggccttgagccggttcagcaattcctgaaagagtacgtgttccctaaaataaacgatggtgctttttctcatgtgatggatttcaaaagccagcttcaagaatttgtacagcgggacggaaaaggatcgcttgagtacaaaattctcaatgaaaaagggcctgcccacaaccgggaattcgaggcgctggtctctcttaaaggtgaggcgctcggcatcgggaacggacgttccaaaaaagaagccgagcagcatgcggcacaggaagctcttgcaaaattgcaaaaacatcatacgaaacaataaaatccccctgtatccctagggggatttcagtatgtctgcgcctgatataagcgggtgattatgataatattgagatacttatacgataaggaggatctgggatgttcctcaaacgtttagacgttataggatttaaatcatttgcagaacggatatccgttgactttgtaaaaggcgtcacggccgttgtcggtccgaacggcagcggaaagagcaacattaccgaagccatccgctgggtgctcggcgaacaatcggcacgctcgcttcggggcggaaaaatggaagatatcatttttgcgggaagtgattcgcgcaagcggctgaaccttgccgaagtcacgttaacgcttgataatgaagatcaatttctcccgatcgattatcatgaagtcagcgtgacgagacgggtgtatcgttccggagaaagtgaatttctcatcaacaatcagcagtgccgcctgaaagacatcattgacttatttatggactccgggctcggaaaagaagcattctctattatcagccagggaaaagtcgaagagattctcagtagcaaagcggaagaccgccgcagtattttcgaagaagctgccggcgtgctgaaatataaaacaagaaagaaaaaagcggaaaacaaactgtttgagacgcaggataacttaaacagggtggaagatattctccacgagcttgaagatcaggttgaaccgctgaaaatccaggcatcaatcgccaaagactacttagaaaaaaagaaagagcttgagcatgtcgaaatcgcccttaccgcctttgacatcgaacaactgcatggcagatggtcgggtttaaaagacaaggtgcaggctgctaaagaagaagaattggcggaatcatcggctctgtccgcaaaagaagcgatgatagaagagacgagagataaaatccacgcgcttgatgaatccgtcaacgaactgcagcaggttctgctcgtgacaagtgaagagctggaaaagctggaaggccggaaagaagtgctgaaagagcgtaaaaaaaacgccgcgcaaaaccgggaacagctagaggaatccgttacacattacacgaacaaagaagccgaactgaaagcggacattgaaaagcagtctgccgtctatgataaacttcgtgcggaagtgaagcggttaaacgcccaggtgaaagaaaagcagcaggctctcagtctgcataatgaaaatgtagaagagaaaatcgaacaattaaaaagcgattactttgaattgttaaacagccaggcgtcgattcgcaacgagctgcagcttttagatgatcagatgtcccaatctgcggtccagcaggcgagactgaccgcaaacaatgaaaaataccttgaagaacgtaacgatattgcagtccgcaaagcggcgtgcgaagaagaattggccgccgttgaagaggatattcacaatcaggtcgtccgctttcgcgaagtccagacagcatatgaacagaaaaaacgccagtatgaaaagaaagaatcagcgctgtatcaggcatatcaattcgtccagcaggccagatccaaaaaagatatgcttgaaacgatgcaaggcgatttttcaggattttaccaaggcgtaaaagaagtgctgaagcagaaagagcagcttggcggcatccgcggcgccgttctcgaactgattgccaccgaacaaaaatatgagacggcgatcgagattgcactcggcgcagcggcgcagcacgttgtcacagacgatgagcaggcggcgcggaaagcgattcaatatttaaaacagaattccttcggccgcgcgacgttcctgccgcttacggttatgaaaccgcgccagctccaaacccgtgatgaacagacggcttcaaagcatccgtctttcctcggcacagcgagcgggcttgtcacatatgatgcggcgtatcggaatgtcattcaaaaccttctcggcaccgtgctgatcactgaagatttaaaaggcgcgaatgaactggccaagcttctcgggcaccgctaccgcatcgtgacgcttgagggcgatgtcgtcaatccaggcggatcaatgacagggggcgcggtcaaaaagaaaaacaattctctgctcggcagaagccgcgagcttgagacggtgactgcgcggcttgccgaaatggaagaaaaaacagctctgctcgaaaaagaggtcaaagcgctgaagcaggccattcaagagcttgaacatacgctgagcggcctccgtgaagacggtgaagctttcagaacaaagcagcaggatgtaaaaggcaggctgtatgaactcgaagttgctgaaaagaacatcaatacccatctggagctttacgatcaggagaaagcatcactgacggaaagcagccgggaaaaagagacgcgcaaatcagctctggaagaacagctgagtgaggcatccggccagctgaaagagcttgaggaagagatggaaaggctgacaaaacaaaagcagaccctatcctcaacaaaagaaacgctctctcatgaactgacggaatgtaaagtggccgctgcgaaaaaagaacaggcgtgctcgagtgaggaagacaatctcaaaaggctgaaaaaagagcttgaagaaacgcagctcgctctgaaagaaacacgggaagatttaagcctcctgacctcagagatgacgtccagcacaagcggagaggagcagcttgaagaagcagcccatcataagcttcacgataaaacgagaacgatcgaattgatcgccagccggcgcgaccagcgtgtgaagctccagcgggcgcttgatacgaacgagcttgagctgaaagagatgaagcgtctgtacaagcaaaaaacggacattctgaaagatgaagaggtaaaactcggccggatggaagttgagcttgataatctcttgcaatatttacgcgaggagtacagcttatcctttgaaggggcaaaagaacaatatcagcttgaactcgagcctgaagaggcgagaaaacgagtcaaactgatcaagctttcaattgaagagctcggaacggtcaatctcggcagcatcgatgagtttgaaagagtaaacgaacggtatcagtttttaacagagcagaaaaatgacctgacggaagcgaaaaacacactgtttcaagtcattgaagaaatggattctgaaatgacgaagcgattccatgaaacgtttatccagatccgttctcaattcaacgatgtgttccgttctttattcggaggaggacgggctgaactgaagctgactgatccgaatgatcttcttaattccggggtggacattatcgcgcagcctccgggcaaaaaactgcaaaacttaaatcttttgtcagggggagaacgggcgctgactgccattgcccttttattctctattctgaaagtaaggcccgtgccgttctgcgtccttgatgaagtggaagctgcgcttgatgaagccaatgtattcaggtttgcgcaatatttaaaaaaatacagcggcgacagccagtttatcgtcatcacccacagaaaaggcaccatggaagaagcggatgtcctctacggtgttacgatgcaggaatccggcgtttcccgaatggtttcggtcaaactggaagaaacaaaagaattcgttcagtaacgaggaaagaggttgaaagatgagcttttttaaaaaattaaaagagaaaatcacgaaacagacagactccgtctctgaaaaatttaaagatggtcttgaaaaaacaagaaattccttctcaaataaagtgaacgaactcgtctcccgctaccggaaagtcgacgaggatttcttcgaggagcttgaggaagtgctgattggcgctgacgtaggttttacaaccgtcatggagctgattgatgagctcaaaaaagaagtgaagctgaaaaatatccaggaccctcaggaagtgcagtccgtcatttctgaaaagcttgtcgacatttataacagcggtgacgaacagatttctgaattaaatattcaggacgggcgcctgaacgttattctgcttgtcggggtaaacggcgtcggaaaaacgacaacgatcggaaagcttgcccataagctgaagaatgaaggcaaatcggttgtgctcgctgccggagacaccttcagagccggggcgattgaacagcttgaagtgtggggagagcgtacaggcgtgcctgtcattaagcaggctgccggaagcgaccctgcggcggttatttatgatgccgtacacgcggctaaagcaagaggagcggatgtgctgatttgtgatacggccggccgccttcagaataaagttaacttaatgaaagagcttgaaaaggtcaaacgcgtcatcgaacgcgaagtgcctgaggctccgcatgaggttctcctcgcgcttgacgcgacgacaggtcagaatgcgatggcgcaggcgaaagaattctccaaagcgacgaatgtgacgggtatcgcattaacgaagcttgacggcaccgcaaaaggcggtatcgtcctggcgatccgcaatgagcttcacatccccgtgaaactggtcggccttggagaaaaggttgacgatctccagcggtttgatgcagaatcttacgtatacggtctcttttcggatttagttgaaaaagccgaggattaatgaataaaaaacgagtataaaatggacggttttatactcgtttttttatacgcattgatagatcggaatggaggggacagttgttggacaaatggctgaaagctgaattggaaagtaagatcggcgcgataaaccatatgttgctgctggatgaacagggaggcacttcaaccgttcgaaaaatagtgaccggtcaagacgcatttttgctgaaaagttcttttcaacagaagtatcgggaatggttaatgagagaagccttcgttttacaacaactgacggaaactcgtcgtctgcctgttcctatttattatgggatgatacaggaacagcatgccagccatatcatcatgtcatttgaggatggaatcaccctgacttcggctttaagaaaagccaaaggggatactgaaaagaaaaagctgatcaaaagtttcggccagtttctgcagcggctgcatgaaaccgaaatggtctctggtttacagccggaaacagactggctcgatctgcaaatcaaacgagccggggaatatgtcaaaaaaggacaagctgaaggaagtgcagagcttttgaaggaattggacaggtacaggcctgttcctgttcagcagacaatgattcacggtgactgcacgactgataatgtgctggtgagagacggagaggtctatctgtttatcgatgctgcgggaatatcggcgggagatccgcgttatgatgaatcattagcgatcagtcgttttgtcacaaatgaagcatgcctcaatgctttttacgaaggttattgccgctatcgtgtatcaaaacaagaattcgagtattttaacgacggtctgtatgaatttttttgaaaacttattatgtaaaaagagcatcatgctttgacaagataaaaacttgacacacgctctgaaaccatgtaaactaagtttttgtaaagggatttgacttaacaaaggggagagctcaaatgtcgctcgaaaaaacgacgagaatgaactatttgtttgacttctatcagtcgttgctgacgtcaaaacaaaagagctatatgtcgctttattatctggacgatttctcccttggtgaaatagccgaagagtatgacgtttcaaggcaagccgtttacgataacatcaaacggactgaagcgatgcttgaacaatatgaagaaaaactgctcctttttaaaaagtttcaggagcgtaaagaaatgtttacaaagctgaaagagcttgcttccggcttgcaggaagaggaaaaaatgacggctctgattgaagcgcttgagaaattagattaggaggcggcaaacaatggcatttgaaggattagccgaccgactgcaaaagacgatttcaaaaatccgcggaaaaggaaaagtcagcgaacaagacgtaaaagagatgatgcgtgaagtccgtcttgcgcttcttgaggctgacgttaactttaaagtcgtaaaggattttgtgaaaaaagtaagtgaacgggctgtcggacaggacgtcatgcagagtctgacacccggtcagcaggttattaaagtcgtaaaagaagagcttaccgagctgatgggcggcgaagaaagcaaaattgccgccgccaaacgcccgccgaccgttattatgatggtcgggctccaaggtgccggtaaaacgacaaccacggggaagcttgccaacctgctgcgcaaaaaacataaccgcaaaccgctgctcgtggctgcggatatttaccgccccgccgcgattaaacagctggaaacactggggaaacagcttgatatgccggtcttttcgcttggcgatcaggtcagcccggtggaaattgccagacaggcgattgaaaaagcgaaggaagagcatcatgattatgtgattttagataccgccggacggctgcacatcgatcatgaactgatggatgagctctccggtgtaaaggaagtcgcaaatcctgaggaaattttccttgtcgtcgactcaatgaccggtcaggatgcggtaaacgtcgccaaaagctttaatgaccagctcggtttaacgggcgtcattttaacaaagcttgacggggatacccgcggaggtgcggcgctttctatccgcgcggtcaccgaaacgccgattaaattcgccggaatgggagaaaagctcgatgctcttgaagcgttccatcctgaacggatggcatcccggattctcggaatgggtgacgtgctgacgctgattgaaaaagctcaggcgaccgttgatgaagacaaagccaaagagcttgagcagaaaatgagaacgatgagcttcacattggatgattttctggagcagctcggccaggtccgaaacatggggcctcttgacgaactgctgcaaatgatgcccggcgcaggcaaaatgaaaggcttaaaaaacatccaagtcgatgaaaaacagctgaatcatgtggaagcgatcattaaatcaatgactgttcttgaaaaagaacagccggatattattaacgccagccggcggaagcggattgccaaaggaagcggaacatccgttcaggaagtcaaccgtcttttaaagcagtttgaggaaatgaaaaaaatgatgaagcagatgaccaacatgtcaaaagggaagaaaaaaggctttaaattaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccgcgtgacggccgtttcatcgaaacagtcggcacatacaacccggttgcaaagccggctgaagtgaaaatcaacgaagagcttgctcttaaatggcttcaaacaggagctaaaccttctgatacagtccgcaacttgttctcaagccaaggaattatggaaaaattccacaacgctaaacaaggcaagtaatgactgatcagaacttggaagatttgattgtcagcattgtggctccgcttgtcgaccatccggaagacataacggtcacaaaggaagagactgatcaaaagattgcgctgcgcttatctgtcaataagtcagataccggtaagattatcggaaagcaaggccggactgcaagagcgattcgaaccgtcgtttttgcagctggcgcacagtcttctaagaaagttcaatttgaaatatttgactgaaaaagggagagggccggcacctcccctttttttacacgtaaaaaaggcaaatgaacagaaatatgttggaagagtggggagtctggtcctatgcagattattcacagggtaaccgttatgcaggttctgaccgagcaaagcaaggaaaagcttttggcctcttttgcagaaaaaaagcaaacgcttgaacgagaatgcagccagctctattttcagcttagaaaacatgaaaaagatcagcagaatcccgatgtagcggaatcttttaaaaaagccattgaaaaaagacaagacaaaatcaaaatgatcgatttccaaataagccagacagagtcgctcccgcttggaagcgaagtgaaggaaaaggagatcgatgcgctgctttcaatcaatgtcggtgataactggcatgaaaaaacagcggcaaataccatcgtcataaaagacggggtagtaattgaaatccgcccgaggtgataatatgacaaacagatggtttaatgtaggcaaaattgtaaatacccacggcattaaaggcgaagtgcgggtcatttctaaaacggactttgccgaagaacggtacaagcccggcaatacgctctatttgtttgcggaaggggctgcggagccaatcaaagtaacggtcagcgcccacaggctccacaaacagtttcacctgctgcaattcaaagaaatgccgagtctcaatgaagtcgaacacttaagaaacatggtgatcaaagtccctgaagaagacttgggagagcttgaagaagatgaattttattttcatgaaatcatcggctgcgaggttgtgtcagaagacggggaactgattggcacagtgaaggaaatcttgacgcccggggctaatgacgtatgggtggttgcaagaaaaggcaaaaaagatgcgctcattccgtatattgcttctgtggtaaaggatattaatataaatgagaagaaaattaagattcatgtaatggaagggttaatagacgaatgaaaatcgactttttaacactgtttcccgaaatgtttcaaggggtgctcggctcatccattctgcaaaaagcacaggaaaaagaggctgtccgttttgacgtcatcaatttccgggctttttcggataataaacaccaaacggttgatgattacccgtacggcgggggagccgggatggtgttaaagccgcagcctgtatttgatgcggttgaaaagctgacagccggtacggacgccaagccgcgcattattctcgtctgcccgcaaggtgagcgttatacgcagaagaaagccgaggagctggcggaagaggaacatctcatgtttatttgcggacattatgaagggtatgatgaacggatccgggaacatcttgtcactgatgaaatctccatcggggattttgtgctgaccgggggagagctccctgccatgatgattgccgacagcgttgtcaggcttttgccgggcgtcctcggaaaagaagcatcccacgtggaggattccttcagcacggggcttttagagcatccgcactatacgaggccagcagattataaaggcttaaaagtgcctgagacccttctgtccggcaaccatgccaaaatacaagaatggcgcaataaagaatcaatcagaagaacctttttaagacgtccggatcttcttgaaaactatcctctcactgatgagcaaagaaaatggatttccgagtgggaaaacgaatagattctattgcgcaggtgatgaagatatgataagatactacttgtggcttaaggaggcttatccttcagaagcttgaaaacgatgttccgctgtgccttgcagttgtggccaagagcatctgttggaaggagttgaaaacgatgcaaaaactaattcaagatatcacaaaagaacagcttcgcactgatcttcctgcgttccgtcctggtgacactttacgtgtacacgtaaaagttgttgagggtaaccgtgagcgtatccagatcttcgaaggtgttgtgatcaagcgtcgtggtggtggaatcagcgaaacgttcacagttcgtaagatttcttacggtgttggcgttgaacgtacattccctgtacacacaccaaaaatcgcgaaaatcgaagttgtacgttacggtaaagtacgtcgcgctaagctttactacctgcgtgaacttcgcggaaaagcggctcgtattaaagaaatcagacgataatgataacgaacgaaaagagcttgttacccgtaacaggctctttttttatatgaaatttgtaaaagcggaacaagcaacgtaaaatacataagagatcatcggaacatccggttccggtaaataaggcaggtgtcgaagtcacatgaccattcaatggttcccgggccatatggctaaagcgagacgggaagtaacagaaaaactgaaattaattgatatcgtatacgaattggtggatgcgagaatcccgatgtcatcgagaaatccgatgattgaggagattttaaaaaataagccgcgcattatgcttttaaataaagccgataaggcggatgcggctgtgactgcccagtggaaggaccactttcaggaacagggcattccctctctttcaataaactccgttaacgggcagggactgcatcaaatcgtgccgtcctcgaaagagctgctgaaggataagttcgataaaatgaaagcaaaaggcattaggccgagagcaatccgcgcattaatcatcggcattccgaatgtcggcaagtctacgctcattaaccggctggccaaaaaaaacattgccaagacgggagacaggcccggcattaccacttcacagcagtgggtaaaggtaggcaaggaattagagctgctcgatacaccgggaattttatggcctaaatttgaagatgagcttgtcggcttgcgcctggcgatcaccggggcgattaaagatacgattatcaacctgcaggatgtggctgttttcgggctgcgctttctggaagagcattatcccgaccgtttgaaggagcgctacggacttcaggaaatccctgaggatatcgccgctcttttcgacgcgatcggtgaaaaacgcggctgtttgatgggcggcggaatggttgactatgataaaacaacggaagtcatcattcgggacatccgtacggaaaaattcggcaggctttcatttgaagcaccatcagaataaagacgcgcagcgatgcgggtctttattttttccgcagaataccgatatacataatgtaagggagaagagaacgtgaatacattaaccgtaaaaagcgtaaaagaacgcctgcaagaggtcagggacgaaagcgaccccttccttgcccaatgtgagaaagacccgagaaaaagcgtacagacgcttttagagcaatggctgaaaaagcacgcgaaggaaaaagctcttaaagagcaatggctgaacatgacggcatacgaaagactgtcatccaaaaagggcttccgcctgattgcgggtgttgacgaagccggaagagggccgcttgccggaccggttgtcgccggcgccgtcattttgccggcagaatgcgagattctcggtctcacggactcgaagaaattgtcggaaaagaagctcgaggagtattacagccggatcacggaagaagcggcggctgtaggagtcggcattgtccatgcggacgtcattgaccggatcaacatttatgaggccgcgagactggcgatggtaaaagccgtcaatgctttaacggaaacacctgattatctgcttgttgatgccatgacccttccgcttgacattccgcagtcttcagttataaaaggggatgccaaaagcgtgtcaattgccgccggagcctgcatagcaaaagtaacgcgggaccgtctcatggctgagtacgccaaaacctaccccatgtacggctttgaaaaaaataaaggctacggaacgaaagaacatcttgaagctcttcaggcatacggaccgacaactattcaccgaaaaacgttcgctcccgttcaatcttattgttagaaaagaggcttaagacatgaacattagcggcgaaatccaagcggctttcagacagctgacggcggaaatccctccggaccggcaggacggcgataaagacagcggtactcaaaggctgctgttagggaaggttctccgtttgctggacgatcaaagcgctcttatccagatcggcggccggacgatgcagggaaaacttgaaaccgcccttcgtccgcaggcgtattactggttttcttatgacaaacagccggcggaaaaaacgggccggcttcatgtcatcgaccaattcgaaggaagcccgaaaaccgttcaggaagcagcgggtagactgttaaacgctctttccgtcaaaccgggccctgtgtctctgcagattgccgaaacgtttatgcagcagaagctgccgatgacggaaaacagcctcaaagcctgcatccgctgggctgaatcgcttccggccgccgaattgaaaaaagcggcggaaacaatcgtatttgcgctgaaacgggaactgcccgcacatccggaagtcttgtcagccattcatgccgttaaatatccggttccgacccgtcgcctcctctcaggactgcttcaggcaatcaatcaggctccgcaatcggcaaaagagctgtctgtgctcaaagaggcggtttctgacgtattaaacgcggaaacggatcttcatgcagaacgtctcttgaagaagcttgccgaggctgcacgcatgccgatcccagaaaccgggctgatggatgaagaagaacggacggaatccaaacaatcaccatttgtccgagagactcgtgaaaacggaaaggcagtctcaagccaaccttctcctccgagtgcgcggacagatccggaacttcctgaaaaaacggcaaaacagattatagagaaattaatgacatcggcagaaaaaactgaaaaccgccccgtaaaagtaacggcggagatcattaaggctttcatttctcaagaaaaaacatttaaaacagcacctgttcttcaaaaagcacatctgacagaacaggaggcggctgttttcgaaaaagccgttcagctcaccgaattgaaatatgcggaaaaacatgatgtattaagccttttgcagaaaatcaaaaaaggattgggcacgcgtgatgaattatcattcattacagcgcttgaaaaaggcgtatctcttcagccggagaaacaagcgctgaaaaccgccctccaagccgtccggacgcttcaagaagcgccccaatccgttaaacaagaggctgaaccgcttattcataaattaaacggccagctgtttattgagcagcataacccttcttttacgcagatggtgctgtcatttccgctgggagcgtccgcgtatgagaatgatatcacagttctctttaaaggacggaagaagccggacggaaaactcgatccgtcacattgcaggctcctgtttttgctgcatcttgaaacactgcaagaaaccgttgtggactgcatgattcagcaaaatgtaatgaccattacggttgagactgattttgagcttcagtcggccatcgatcctctcgtaccggctttaaaagaagccgtaaaagaaacgggcttcagcctgtcaggcgtcacggctaaaaaacggcgcccgaaagaccagagcgctcttgtggaagagtttatagaaaaagacggcggaagaaaagtggatgtgaaaatatgaaagagcaaacgccgttaagaagagctgtcgccctgcattacgaccggcagaaagaccaagccccgaaggttgtcgcaacaggcagggggcatgtggcggaaaatattataaaagaagctgagaaggctggggtccccattcaggaagacagaacccttgtcgaattaatgcgccatttgacggttgacgatcagataccggaggcgctctatgaaaccgtggccgaaattttttcatttgtttacagactggacgaaaccctgaaaaacgaaaaataaggaccattcatttcccggactccgtttaaatttatattttcaataaaataaaagttagaatgtttggaaggatataaagattttgttttgaaccctagacaattcttccagtattatatagaatgaaagcgcagtctatttttagttttgctacataagttaggaggatgggaaatgaatatccatgagtaccagggaaaagaagtcctcagaaaatacggggtgtctgttcctgaaggtaaagtggcttttacagcagaggaagcagttgaaaaagcagagagcctgtcaagctcggtttatgtcgtaaaggcgcaaatccatgctggcggccgcggcaaagctggtggggtaaagattgcaaaaacaaaagatgaagtgaaagagtatgccgaagaactgttaggcaagacgctcgtcacacatcaaacgggtccggacggacaagtaataaaacgcttacttattgaagaaggctgcgatattaaaaaggaatactatgtcgggcttgtacttgaccgcgctacttcaagaatcgttttaatggcgtctgaagaaggcggaacggagattgaagaagtagcggaaaaaacacctgaaaaaattaaaaaagcggtaattgatccggctgtcggcctacagggctatcaggcaagggaaattgcattcgcaattaacatcccgaaagagcttgtcggcaaagccgctaaatttatgctcggtttatataaagcatttgttgagaaggactgctccatcgccgagatcaaccctctcgtcgttacgggggacggaaacgtcatggcgctggatgctaagctgaacttcgacagcaatgcgttatacagacaaaaagacattatggaatacagagatttagatgaagaagatccgaaagaaatcgaagcgtcaaaatacgatttaagctacatttcccttgatggaaatatcggctgtatggtaaacggcgcgggtcttgcaatgtctacaatggatatcattaaacactacggcggagaacctgcaaacttccttgatgtcgggggcggcgcaaccgcagaaaaagtgacggaagcttttaaaatcattctttccgatcaaaacgtaaaaggaattttcgttaatattttcggaggcatcatgaagtgtgatgttatcgccgagggcgttgttgaagcgacgagacaagtcggattgacattgccgctggtcgtgcgccttgaagggacaaacgtagatttaggaaagaaaatcctgaatgaatcaggcttaaacatcacatctgcggaatcaatggcagacggcgcacagaaaatcgtatccttagtttaggaaagaatgaaaggcaggggaccagataatgagtgtttttatcaataaagatacaagagttattgtacaggggattacaggttctaccgctttatttcatacaaagcagatgctggaatacggcacgaatatcgttggcggtgtaacacctggaaaaggcggaacggaagcggaaggcgtaccggtattcaatacggtcgcagaagcggttcatacaacgggcgctgatgcgtcagtcatctacgttccggctccgtttgcggcggacgcaattatggaagcggttgacgcggaaattgatcttgtcatttgtatcactgagcacattccggttttggacatggtgaaagtgaagcgctttatggaaggcaagaaaacgagattaatagggccgaactgcccgggtgttattacacctgaagaatgcaagatcggcattatgccgggatacattcataaaaagggtcatgtcggcgttgtatcccgttcaggaacattgacatacgaggccgtccatcagctttcagaagccggcgtaggccagtctaccgctgtagggatcggcggcgatccggtcaacggcacgaactttattgacgtgttaaaagcgttcaatgaagatcctgaaacacatgccgttatcatgatcggagaaatcggcggcacagctgaagaagaagcggctgagtgggtgaaagcaaacatgacgaagcctgttgtcggctttatcggcggtaaaaccgcccctccgggaaaacgcatgggccatgcgggcgccatcatctccggaggaaaaggcacggcagaagaaaaagtcaaaacgatgaacgcctgcggaattgaagtcgcggaaaccccttctgtaatgggtgaaacgctgattaaggtgttaaaagaaaaaggcttatttgaaacgtgcaaaacgcactgatcgaagcaggggcagccgtaacggctgttcctgtttttgctgaaaaaagaggaggttgccagatttggatcaagcatcgcgctgtttaatggtctgcagtattaatcaaatcatttccccgtctcttctattaaaatggtggaaagctgatcactctctgtcttttttaccggatccgcatccattaactgctttatcagaagggaaaacagtgcccgaagcaatttttcgggaaatagagcgcaaggatccggaacttgatgaagttctgtccgattaccgccgcgaaggcattactgtcattccgatttcatcaagccgctacccaacatggcttaaatcgatttatgatccgccggctgtcttgtatgcaaaagggaacacgccgcttcttgaaaaaggcagaaaaatcgggattgtaggaacgcggaaaccgacggaagacggaataaaagcggctgggcatctttccgccgaactctcaaaaaaaggctgggtcattgtaagcgggcttgcatccggtatagacggattgtctcataaggcgagcatcagggcaaaagggcttacgatcggcgtgatagccggcggattccatcacatctatccccgggaaaatctcctgttagcagaatacatggctgaacaccatctcctactctcagaacatcctcctgaaacaaagccgaaaaaatggcattttccgatgagaaaccgcataatcagcggactaagtgaaggaattgtggtcgtacagggaaaagaaaaaagcggttcattaatcacagcttaccaggccctcgatcaaggcagagaggtatttgccgttccaggttccatatttaatccatattccggaggacctataaaactcattcaagaaggggcgaaagctgtattatgcgcagaggatattgacggagagctgaccgcccgatgcgttcagtatacggaacccttttgaaatatcgtttgacaaacggtattgtaatatttaataatagtgaggatttaaagttgcatattattttcatgtataaaatgacgttcatcataaagaatgaaatgttgaaagccataaaaaggcagctctaaaatgaattgatacttgaaaagagagagaacacctcttgagggggatgaaaatgtctgattatctagtcatcgtggaatcgccggcaaaggcgaaaacgattgaacgttatttagggaagaaatataaagtcaaagcttcaatgggacatgtccgggatcttccgaaaagtcaaatgggagttgacatcgaacagaactttgaaccgaaatatattacgatccgcggaaaaggccctgttttaaaagaattaaaaacagcggcaaagaaagcaaaaaaagtctatctcgcagccgaccccgacagagaaggggaagcgattgcatggcatctcgcacacagccttgatctggatctcagctcggactgccgggtcgtctttaatgaaataacgaaagacgccattaaagaatcatttaaacatccgcgcatgattaatatggatcttgtcgatgcgcagcaggcgcgccgcatactagacagactcgtcggatacaaaatcagcccgattctttggaaaaaagtaaaaaaaggcctcagtgcgggccgtgtgcaatccgttgcgctccggctgatcatcgaccgggaaaaggaaatcaatgactttaaacctgaagagtactggacgattaccggctcatttttaaagggaaaagagacgtttgaagccggatttttcgggaaaaacggcaaaaagcttcctttaaaaagcgaagaagacgtaaaagccgtccttgctcagctgaaaggcaataagtatacagttgacaaggtgacaaaaaaagagcgcaaacgaaatcccgctctgccgtttacaacgtccactctgcagcaggaggctgccaggaagctgaatttcagagcgaagaaaacgatgatgatcgctcagcaattatatgaaggaattgatctcggcaaagaagggacagtcggactcatcacgtatatgagaacggactcaacgcggatttccaatacagccgttgaagaggcgtcagcttttattgatcaggcgtacggaaaagagtacttagcgggaaaacggaaaccggcaaagaaaaatgaaaacgctcaagatgcccacgaagcgatccgcccgacttcagtactcagaaaacctgccgacttaaaagcggtgcttggaagagaccagctcagactatacaagctgatttgggagcgctttgttgcaagccagatggcgcctgccgtccttgatacgatgagtgtcgatctcagcaataacggattgacattccgggcaaacggaagtaaagtcaaattcgccggcttcatgaaagtctatgtagagggtaaagacgatcagctggaagaaaaagaccgcatgcttccggaccttaaagagggagacacggttttatcaaaagatattgagcctgagcagcactatactcagccgcctccgcgttatacagaggcgcgcctggttaaaacgcttgaagaactggggatcggccgtccttcgacatatgcgccgactcttgacaccatccagcgccgcggttacgtgggattagacaataaacggtttgtgccgactgagcttgggcagatcgtgctggatcttatcatggagtttttcccggaaatcatcaacgttgaattcacggctaaaatggaaagagaccttgaccatgttgaagatggccagacagaatgggttcaaatcattgacagcttctataccgatttcgaaaaacgcgtgaaaaaagcggaagctgaaatgaaagaagtggaaattgaacctgaatacgcagatgaagattgtgaattatgcggctcccggatggtttataaaatgggccgatacggtaaatttatggcgtgttccaacttccctgactgccggaatacaaaaccgattgtcaaacaaatcggcgtaaaatgtccgaagtgccatgaaggaaacattgtcgaacgaaaatcaaaaaagaaacgcgtcttttacggctgtgaccgttatcctgaatgcgacttcgtatcttgggacaaaccgattgaacgaaaatgcccgaaatgtgaaaatatgctcgtagagaaaaagcttaaaaaaggcatacaagtccaatgcgtcgaatgcgattataaggaagaaccacagaagtagcggtgagcagagccttgctcaccttctttgtgtggaagggacaaacaacaggagatgaaaagaaatgaaccagcaaacagttaatgtaatcggagcaggccttgccggaagtgaagcggcatggcagcttgcaaaacgaggaattcaagtaaaactatacgaaatgcggcccgtcaggcagacggcagcccatcatactgataaattcgctgaactggtatgcagcaactccctccgttcaaatacactcgccaatgcggtaggcgtattaaaagaagaaatgcgggcgcttgactcagcaatcattcaatctgctgataaatgctcggttcccgcagggggagcgcttgcagttgaccgccatgaatttgcgcaaagcgtgacggatctcgtgaaaaaccatccgaacgtaacggttcttactgaggaagtaacagagattccggaaggcccgacggttatcgcgaccggaccgcttacgtcagaatcgctttcacagcagctgaaagagctcacgggagaagagtatctgtatttttatgacgcggcggcgccgattgtcgaaaaagacagccttgatatggagaaagtgtacttaaaatcccgttacgacaagggagaagcggcatacttaaactgcccgatgacagaggaagagtttgaccgtttctatgaagcattgacgacggctgagacggttcctttaaaagaattcgaaaaagaaatcttctttgaaggctgcatgccgattgaagtcatggcgaaaagaggcaagaaaacgatgctgttcggaccgatgaaaccggtcggactggaagatccgaaaacaggcaagcgcccttatgcagtcgttcagctcagacaggatgacgcggcgggaacgctttataatattgtaggttttcagacacatttaaaatggggagaccaaaaagaagtgcttaaactgatccccggccttgaaaatgttgatatcgtcagatacggcgtcatgcacagaaacacatttatcaactcgccgagtcttttgaacccgacatatcaatttaaacagcggaacgatctgtttttcgcgggccaaatgaccggtgtagagggttatgttgaatctgccgcttcaggtcttgtagcgggaatcaatgccgccaaacttgtgctcggtcaggatcttgtgacattcccgcaggagacggcgatcggaagcatggctcactacattacgacgacaaatcagaagaacttccagccgatgaatgcaaacttcggcctcttaaaagaattgcctgtaaaaattaaaaacaaaaaagaacgaaatgaagaatacgctaaacgcgcaattgagactattcaaactatttcgaaaacgatatagcttttcattgcaacttcgatgcattatatgataccatttaaaagcccttcggagagggaggtcttcataatgactgagaatgttaacttttttttaaagttattcgttgaatatttacaaattgaaaaaaattattcacaatatactattgtgaattatgttaattcgattgaagaatttgggatgtttctgcatgctcaaaatataaatggaatgaaagaagctgcatatcatgatgtgagaatatttttgacagaggcttatgaaaaaggcctgtcaagaaaaacaatcagcaagaaaatttcagctttgagaagcttctataaatttttaatgagggaaaagcttgttgaagagaatccgtttcagcttgttcatctgccgaaacaagagaaacggattccgaagtttctttatgaaaaagaacttgaggaactattcgctgtctcagacagaagtcagccgtcagggatgcgcgatcaggccctgcttgagcttctttatgcgaccggaatgagggtcagtgagtgctgtacgctcactgtcggcgatcttgacctgttcatggatacggtgctcgttcacgggaaaggcaagaagcagcgctatatcccgttcggctcatatgcccgtgatgcgctggagctgtatatcaacagcggaaggcagtgcctgcttgaaaaagcaaaagagcctcatgatgtgctgtttgtcaatcaaagaggcggcccgctgaccgccagaggaatccggtatattttaagcgggcttgtaaaaaaagcatccggcactttacatatacacccgcatatgcttcggcacacgtttgcgactcatctgctgaatgaaggggctgatttaagaagcgtccaggagcttttgggccattccaatctgtcttctacgcagatatacacgcatgtatcgaaggaaatgctgagaaacacatatatgtcccaccacccgagagcttttaaagaaaattaaaaggaggcccttctcatgtcatcttttcatgcgacaacgatttttgccgtccagcataacgggaaaagcgctatgtcaggagacggccaggtcacattcggtcaggctgtagtcatgaaacatactgcgagaaaagtgagaaagctgtttaacggaaaggttctggccggatttgcgggatctgttgcagacgctttcacactttttgaaatgtttgaggcgaagcttgaagaatacaacggcaatttaaaacgggcgtcggttgagcttgcgaaagaatggcgcagcgataaagtgctgcgcaagctggaagccatgctgattgtcatgaaccaggataccttgcttctcgtatcgggaacaggtgaagtgattgagccggatgacggcattttggcaatcggctccggcggaaactacgccctgtcagcaggaagagcgctgaaaacctatgccggagagaatctgtccgccaaagatattgcaaaagccgctttgaaaatcgcaggcgagatttgtgtgtacacaaacgatcagatcattttggaagaacttgaatagaaaggacttgaggcgcatggaaaacaaaccgttaacaccgagacaaatcgtagatcggttggatcaatacattgtaggacagcaggatgcgaaaaaagctgtcgccgtggcattaagaaaccgctatcgcagaagtcttcttgatgaaaaactgagagacgagatcgttcccaaaaacatcctgatgatgggcccgaccggggtggggaaaacagagatcgccagacggatcgccaagcttaccggtgcgccatttataaaaattgaagcgacaaaatttacagaagtcggctatgtaggcagagatgtcgaatcaatggtcagagaccttgttgagacatccgtgcggctcattaaagaagaaaaaatcagcgaagtgaaagaacaggctgaagaaaatgcaaacaaacgtatagtgcggcttctcgttccgggaaagaaaaaacaagcgggtgtgaaaaatccgtttgaaatgcttttcggaggaagccagacggcaaatgatgatgatgccgaccagcaggaagaagcaagccttgaagaaaaaagaaaacgcatggcgcatcagctcgcattgggagagctcgaagaccattacgtctccgtagaggtggaagagcagcagccgtcgatgtttgacatgctgcaaggctccgggatggagcagatgggcatgaatatgcaggatgcgctgagcaatctgatgccgaaaaagaaaaaacgccgcaaaatgacggtcagagaagcaaggaaggttctgaccaatgaagaggcaggcaaattaatcgatatggatgaagtcggccaagaggccgtgttaagagctgaagagggcggcattatctttattgacgaaatagataaaatcgcaaaaaacggaggggcttcttcctcagcagatgtatcgagagaaggcgttcaaagagatatccttccgattgtcgaaggatctaccgtcgtcacgaaatacggctccgtcaagacagatcacgtgctgtttatcgcagccggggcattccatatggccaaaccgtctgatctgattccggagctgcagggccgctttccgattcgtgtagaattgagcaagctgacggtggatgattttgtgaagattctcgtcgaacccgataacgcgctgttaaaacaatatcaggctttattgcagacagaaggtatatctcttgaattttctgacgaagctattcgtaagatcgccgaagtggcttatcatgtgaatcaggacacggacaacatcggagcgagaaggcttcacacgatattggaacgtctcttggaagacctgtcgtttgaagcgccggacgtgacgatggaaaaagtcgccatcacgccgcaatacgttgaagaaaagctcggaacgattgcaaacaacaaagatctaagtcaatttatattgtgaaaatttaataagaggaattctaggaggattatttatcatggctttactacaaaaaacacgaattattaacagcatgctgcaggctgcggcaggcaaacccgtaaactttaaagaaatggctgaaacgcttcgtgacgtcattgattctaatattttcgtcgtcagccgcagaggaaagcttttgggctactctattaatcagcagattgaaaatgaccgcatgaaaaaaatgcttgaagaccgccagttcccggaagagtacacgagaaatctgttcaatgttccggagacgtcttcaaaccttgatatcaacagcgaatacacggcgtttcctgtggaaaacagagacctgttccaagcgggcttaacaacgatcgtgccgatcatcggcggaggagagagactgggcacgctgattctgtcccgtctgcaggatcaatttgaagatgatgatctcattcttgctgaatacggagcaaccgttgtaggaatggagattttaagagaaaaagcggaagaaatcgaagaagaggcgcgaagcaaagcggttgttcaaatggcgatcagttctctgtcttacagtgaacttgaagcgattgagcatatctttgaagagcttgacggaaacgaaggcttgctcgtggcaagtaagattgcggaccgtgtcggcattacgcgttcagtaatcgttaacgcgctgagaaagctggaaagcgcaggcgtcattgaatccagatcactgggaatgaaggggacgtacattaaagttctgaacaacaaattccttattgaattggaaaaccttaaatctcattaagacaaaagcaggatccctgaaaatggggtcctgctttttttatggacaataggtgaaaagttgcagtttaaagttgcttattggaagctgatctgagataatccatcttgctgtgtgaaaaaaggaggaagatacagaaattctgctattttcagtcttatattaaacaaatgcttgtagtccaaatactctaggacttaatacctacatgcaaaatagatataattgagcactttttttagcctaacttcatagactttaagcctgttatttcttacaataagcatatggttttacaattctcgacaaggatttttaggagaaaaatatctgaaatggaggtaagtggatttggacttattttctggaactatacaaaatcttgagaatgccttggggagagcggacattaagcaaaaagtcttaactaataacatcgccaatatagatacaccgaactataaggcaaaaaaagtctctttccgaaatttgttagatcaggaaacatccaatcgtgaggcggtaaaaaccgactatcggcacgttgactttacgggttcaggggacgattattctatcgtgtccagcagtgatacatcgtaccagcaaaacggaaacaatgtcgatatcgacaaagaaatgacagatttagccgaaaaccaaattaattatcaggctttggttgaaagaatgagcggcaaattcaattctctgaaaaccgtcttgacaggaggaaaataatgagtggctttcaaagcttaaatatttcgggctccgctttaactgcacagcgtgtccggatggacgtcgtatcgtccaacctggccaatatggatacaacgagagcgaagcaggtaaatggcgaatgggtgccttacagaagaaagctggtatctctccaatcgggaggcgagtcattttcgtcccttttacattccaagatgaacggaacaggaagcgctggaaatggcgtaaaggtatctggcgttacggaagacccgtccgcttttaatctcgtttatgatccggagaatcctgatgcgaataaagacggatatgtgcaaaaaccaaatgtagacccattaaaagaaatggtggatcttgtcagcagcacgagatcatatgaagcaaacgtaactgcattaaacgcctccaaaggcatgcttttgaaggctttagaaatcggaaagtaaggtgatgtaagtggttaacgctattactccttttcagcttcaacaaacccaaaacactcaaaacgtaacgaatcaattaaaccaaactcaaaaaactgattcttcaaaccaaacaagcttttcggagcttttaaaaaactctattgattcgttaaatgagtcacaagtaaaatctgaccaaataacgaacgaactggctgcaggaaaggatgtaaaccttgacgaggtcatgatcgctgcccaaaaagcaaatatctctctgacggccgctaccgaattccgcaataaagccgtggaagcctatcaggaaatcatgagaatgcagatgtagtggtcagattgaagagaatgactggaatgaccgggggttaacatgaatcgtactctaatgcaaatgaaaaccaaaacggcagcgttttggaacaacagatcaaaaacacagaagatactcatggtaagcggcttggccgcattcattattttactcatcgtcgttattatttttacttcgtctgaaaagatggtgcctctttataaagatttgtccgcggaagaagcggggaagattaaagaagagctcgatacgaaaaaggtgtcttctgaacttgctgacggcggcacggtcataaaggttcctgagagccaagtggattcgcttaaagtccagcttgccgcggaaggcctgccgaaaacgggatcaattgattattcgtttttcggacaaaatgcgggcttcggcctgacagataatgagtttgacgttttaaaggttgaggcgactcagaccgaattgtcaaacctgataaatgaaatggacggtattaaaaactcgaaggtcatgatcaatatgccgaaagaagccgtgttcgtcggtgaagatcagccggcagcgtccgcatccatcgttttgcagatgaaaccgggctactcgcttgatcaaaaccagatcaacgggctgtaccatctcgtttctaaaagtgttccgaacttaaaagaagataatatcgtcataatggatcaaaattctacatattatgacaaaagtgacagcggtgcagggtccgtttctgacagttatgcatctcagcaaggtattaagtcgcaggtcgaaaaggacattcaaaaacatgttcagtcactgctcggcacaatgatggggcaggataaggtcgttgtttccgtaacggcggatattgactttacgaaggaaaaacgcactgaagacactgttgaacctgtcgataaagataacatggaaggcatagcggtaagcgccgaaaaagttgcggaaacgtataaaggcgacggcgcagccaacggcggcacggccggaacgggaagcaatgacaccgcgaactatgccgagacaaacggcggttcaaacagcggggactacgaaaaaagcagcaataaaatcaactatgaagtcaaccgcattcataaagaaatcgcggaaagcccgtataaagtgcgtgatttaggcattcaggtcatggtggagccgcctaatccgaaaaatgccgcttccttatcagcacagagacaggctgatatacagaagattttaggaacggtcgtcagaacgtctcttgataaaaacgaaacgcaaaatcaaaacctgacagacaatgatatcaacaataaaatcgttgtatccgttcagccgtttgacggaaaaacaagcctgaacacagattcggcacaatcttcaggtcttccgatctgggtatacattacaggcggcgtactgcttgcggccattattctgcttattattctcctcatcagaaagaaacgctcacaagaggatgaatacgaagaatatgaatatgaaacaccgccggagccggttcgattgcctgatatcaacgaagagaaaattgaaacggaagaaacagtcagacgaaaacagcttgaaaaaatggctaaagaaaaaccggaagactttgctaaattgcttcgaagctggctggacgaggattagggggaatggaaaatggcgaaacgtgatcagaacaagcttacaggaaaacaaaaagcagccatcctcatgatttccttaggccttgatgtatcagcttctgtgtacaagcatttgtctgaagaagaaattgaaagattgactctcgagatttcgggagtcagaagcgtcgatcatcaaagaaaagatgaaatcattgaagaatttcataatatcgcaatcgctcaggactatatttcacaaggcggtttaaattacgcccgccaagtgcttgaaaaagcgctcggagaagataaagcggtaagcattttaaacaggctcacctcttctttgcaggtaaagccgtttgattttgcaagaaaagcggagcccgaacagattttaaatttcattcagcaggaacatccgcaaacgatggcactgattttatcctaccttgacccggtgcaggccggacagattttgtctgagctgaacccggacgttcaggctgaggtggcaagaaggattgcggttatggacagaacgtctcccgaaatcataaatgaagtggagcgggtccttgaacaaaagctgtcctcctcctttacgcaggattatacgcagaccggcggcatagaagccgttgttgaagtgttaaacggcgtagacagaggaacggaaaaaacgatccttgattcattagaaatccaagatcctgaattggcggatgaaatcaaaaaacggatgtttgtctttgaagatattgtcacccttgataaccgtgcgattcagcgcgtgatcagagacgttgaaaacgacgacctcctgctttcattgaaggttgcgagcgaggaagtcaaagagatcgtcttcagcaatatgtcacagcgtatggttgaaacgtttaaagaggaaatggaaattatggggcctgtgcgtttgcgtgatgtggaagaggcgcaatcaagaatcgtgggcgtcgtccgcaagctggaagaagccggagaaattgtaatcgcgcgaggcggaggagacgatattattgtctaatatcattaaacagcaatcatcattttctcctgaacaaaaacggcgcaagctttccttgcaggaagtcaggaaaacacattcccagccagaccgggaggaacttgaaaatccggaggcgctcatggcctttgccaaggccgaagccgacagggtgtctgaagaagcgaaaagtcaattggatcacactcttcggcagattgaagaagagaaaaaccgctgggcggaagaaaaacaaagattgatggaagaagcgaaggcagaaggatataaagaaggcatagcattgggaaaagccgaggctcaagctgaatatgccaatctcatcagccgggccaatgccgttatgggaatggcgagacagtcagtcgaggaaaaactggaaagcgctgaggaagaaattattgagctttccgttgcgctcgctaaaaaagtatggcggcaaaaaagtgacgataaagaggctttccttctgctggtcaaacaggtagtagccgaagtaaaagattatgatgacatctccatctatgtggaccctgaatattatgagacggttcatcagcatatggacgaaattcagcagctgttatacaaagaatgcagattaagcttatatgccgatgaaaaagccgcgaagggaacgtgctcgatagaaactccgttcggacgtgttgatgcaggcatagacactcagctgatgcaattaaagcaaaagcttttaacggcgcttgaggcgggagcggagcaatgaagacacagtatttaatagactcaattgaaacagcggatccgtacaaacgctacggcaaggttaaacgggtcatcgggctgatgattgaatcaaaagggcccgaaagctcaatcggagatgtttgtctcatttatccgaaaggccatgcaaaaaaagcgattaaagctgaggttgtaggcttccaggatgaaaacattctgttaatgccttatctggaagcagccagtatcgcgccgggcagcattgtggaggccactggcgagtcgctccgcatcaaagtaggggcggggttaatcggacaagttgtcgacgcgttcggcgaacctcttgacggccgggcgcttccgaaaggtttgtcccccgtttcgacagaacagcagccgccaaacccgatgaaacgcccgccgatacgggaaaagatgggtgtcggcgtcagatcgattgacagtctgctgacggtaggaaaagggcagagaatcgggatttttgccggaagcggagtcgggaaaagcaccttgatgggaatgattgcgaagcagactgaagctgatttaaacattatcgcacttgtcggtgaacgggggcgcgaggtgcgtgagttcattgagaaggatttaggcgaagaaggcctgaaacgctcgatagtcgtagtcgcgacctctgatcagcctgcgttaatgcgattgaaagcggcgtatacggccaccgccattgcggagtatttccgcgataaaggccggaatgtgatgttcatgatggactccgtcacgagggtcgcgatggctcagcgggaaatcggcctggcagcgggagaaccgccgacaacaaaaggatatacaccttctgtgttcgctattttgccccgtttgctggaaagaacgggcgcgaatgaacaaggaacgataaccgctttttatacggttctcgttgacggagatgacatgaacgaaccgattgccgatacggtgcgcggaatattagacgggcatatcgttctcgaccgggcgcttgccaacaaggggcagttcccggccgtgaacatcctgaaaagcatcagcagggtcatgtctaatatttcagatacagcgcacatagaggcggccaacaaattccgcgatcttctgtcaacttatcaaaactctgaagatctcattaatatcggagcttacaaaagagggtcatcaagagaaattgatgaagcgattcagttttatccgcagcttattcaatttttaaaacaaggaacggaagaacctgctcaactggaagacagcattgcggcattgacgagtctgacaggaaatgaggaataaacatcatggcttaccaattcagatttcaaaagctgctggaattaaaagaaaatgaaaaagaccaaacattgactgaatacagacaatcggtttctgaatttgagacagtggctgaaaaactatatgaaaatatgagcaaaaaagaattgctcgaaaaagacaaagaatcaaagctgaaatgcgggatgagcgttcaggaaatgagacattatcagcaattcgtttccaatcttgagaacaccatctatcattatcaaaagcttgtcattatgaaacgaaatgaaatgaatgagaagcaggaacagctcaccgaaaaaaacattgaagtaaagaaatttgaaaaaatgcgggaaaaacaatttaatatgttcgcacttgaagataaagctgcagagatgagggaaatggacgacatttcaatcaagcagtttatgattcaggggcattaggagcgaatgaaatggccgataaagaaaagagatctggaaagttcggttcaatcctgctttttatcatgatcccgctgatttttctgatcatcgtcgcaagcatcatcctttgggctgccggcgttgatgtgatgaagccgattcaggaaacagccgctaaaacgcctgttttaaaagaattggttcccgaaacgaaagaaatgaaaagcgcggcggaaaagcagaaggaagacagaacggcttctcttgaaaagaccataaaggaacaaaaaagtgaaattaacattttgaataaagatttagacacaagcaagtccgaaatcgataatctgaatcagaaaatccgttcgctgaaacaggaagctgaacagcagcagaaaacgaagacggatgaaacaaaaaaagacgcttcggattcagccggaaaagataaaatgatcaacatctataaaagtatggacagcggtaaagcggcaagcattatcgtaaagctgaaagaaaaagaagccctcgatattttaaatggattaagtaaaaagcaacttgctgaaatcttgacgaaaatgactcctgaacaagcggctaaatatacagaaaaactatccgctgacggaaataaggagtgatgtaagttgaagctgcttgaattaacgggtaatcgtacgcagactgcgcaaaacagcaatgtgaagacgaatgtaaacagcttaggtctatttcagaactggctcctgtcggaaatcacttctccccggcagcccggagatgaaacaaaaacaagtgacgcagagctgaatgatgccctatcgaaaatcggtgattggctgaaagccggcccggaagataaagaattgcagcttaaacagctgcttgaggcggtaaaagctcttgaaggaaagcagacggctgaaacagctcttcctttattgaaacagcttgccgaatccgttgaagacatgttagcgggaaaacagcagggggcgaagcctgaaacgaatgagccggattcttccgcaaaagacggggattccgtcaaggatgcgcttgagaagggcttgcttttcattcaagaagccgtatcccagctcttcacatctcagcaggaactgcctgacagcacgcaggcaaaggcggtttaccgggaaggcgcccgtttattagaggcattgaaaaaacaaggcgttccggaccgcgtgattcaagacctgcggcagacattttttccgaaaaacgaatctgcatctaaactttacgccatgacagccgctgagctgaagagctttcaaagcgtcgcggagcagcttgcgggcctttctcaaaagggaacaaaggaatgggatatggctgaaactgagctgaaagcttttgtgttatctcaatcatctgaatcatcccaagagtcagccgggaaaacggaacagcaaaacggcggcacggtttctcaagcaaaggcgcctgacagcaaattgtctgcacatatactgttttcgggaacgagaagccttgccggcattcagcaagcgtccgcaggagctgaacagcagccggcagaaaataaaccgttaacggatcaggttatcagcggctggaaacagatgaaatacacgcctttcgggaaagcaaccggaagctttacgattcgtcttaatcccgagaacctcggatttgtcacaattaaggtgacaaacgaaaacgggatgtttcaaagcaaaataatcgcatccagccagtccgcgaaagagctgctggaacagcatcttcctcagctgaaacagtcgcttccgaatatgtcggtccaggtcgaccgttttacagtcccgcttcaaagcggggatcagcagcctgtttacgggcagacggcagatcacaataaacagcagcatcagggacagagagagcagaagaaccagcagcagtcaggcgatttcggagatatgctggaggagctttctctcaatgaaatggaggaagaatagttgacatcagtaaactcggattatgccgcggcgggcgcttcaaccacttcaaacgcgaagagcacctccgcagtaaacagcagtacgaatttagggaaagacgaatttctgaagatcttaatgacacaggttcaaaaccaggacccgctcaatccggttgatgacaaagaattcatcagccagatggcgacattttcttcattggagcaaatgatgaatatgaatacgacgatgactaaatttgtagaaaatcaagatccgtttacgatgtatgtgaactggatcggcaaaaatgtcacattcagcgacagcgacgggaaggatcagacaagcccagtcaattcagtcaagcattcaaacggcaattacgtgctcgtgcttgaaaatggcaaagaggtcagtccgtggaatgtcacggccgtcagcgaaacatctaaataaaaagaaacccagggggaatttaacatgttacgttcattgtattccggtatcagcggcatgaaaaactttcagacaaaactagatgtaatcggcaataacatcgccaacgtcaacacagtgggatttaagaaaagccgcgttacatttaaagatatgatcagccagacagtcgccggcggttcaaacgtgaccaattcaaaacaaatcggcttgggtgccgcgacttcttccattgatgtcgttcattcaaccggcgccccgcaggctacacagaataaaaccgacctagccattgacggagacggatactttcagattaatacaggttcgggaatcgtttacacacgtgcggggaatttcggaaaggacaatcaaggcaaccttgttacgactgacgggtactaccttgaaaaaatcggaggcggcaaaatcaatattccgactgatgcgaaagattacagcatcggtgcagacggaaccgttacatacactgatgcaggggatgcggttcatgatgccggacaaatcggtctggtcacgttccctaacagcgccggtctggaaaaaatcggaggcaatctttacagagaatcattaagttcaggagctgcgagcgcagtcaccactccgggcgaaaacggaacgggtaagcttttggcaggctatcttgaaatgtcaaacgtagatctgacagatgaatttaccgaaatgatcgttgctcagcgcggtttccaatcaaactcaaaaatcattacgacttcagatgaaatccttcaggagctggttaatctgaaacggtaaggagggaggagaggcggttaggccgcttctccggattgcatgattcaagtcacccgtttaaacggccagccttttacgctgaatgcgctgtttatcgaacagattgagtgcttccccgacacgacgattacactgtccaacggcaaaaagttcgtagtgaaagaaccggaagaagcagttctcaaaaaagtcatatcgttttaccatagcatacaaatattttcactggatcagggaatagaggaagaagaatgaagaaaaaattagtcatcattttgctgattattttaattgtcatcgccggcctcggaacggcagcatattttgtcgtcagcggacactccggcaaagataaaaagccgacaattgacgaagtcgttgcagccactgtgtctgtcgacgatatcacgacaaacttaaagtctgacagcatcatccgtatcggcatcaagcttgaaaccgactcggctaaagcgaaggaagaacttgaaaaacgcgattttcaggtgaaagacaacatcatttccattttagctgacacaagcgccggagagattgagggagataaaggaagagaagcgtttaaacaatcattaaaagagaaagtaaacagctatctccaagaaggaaaagttcagaaagtgtacattacctcctttaatctgcaataaaaacaaatttgacagaatacggaggtgaagaaaatgtcaggagaagttctctcccaaaatgaaatagacgcactgctttccgccatttccacgggtgaggcggatgcggaagagctgaaaaaggaagttaaagagaaaaaagtaaaggtatatgattttaaacgggctctcagattctcgaaagatcagatacgcagtttaacccggatacatgataactttgcgaggcttctcacaacacacttttccgccaagctcagaacgtatattcatatatccgtcagctcagttgaccaggtgccgtatgaagaatttatccgttccataccgaacatgacgattttaaatttattcgatgttcatccgatggaaggcagaatcatgatggaggttaatcccaccatcgcatacgcaatgctggaccgcgtcatgggaggcatcggcatcactcataacaaagctgacagccttacggaaattgaaacgaatattatttctaacttatttgaaaatgcactgggcaactacaaagaagcttggcaatcaattgctgatattgaccctgaaatgactgaatttgaagtgaatcctcagtttgtacagatggtttccccaaatgaaacagtcgttgtcatttctctcaatacacagataggtgaaatcagcggtgtcattaatctttgtattccccatgtcgtacttgagccgattatccctaagctttccgtacattattggatgcaatcagaccggaatgaagcgaagcccgaagaaacgaagctgcttgaaaagcgcatcatgacggctcaaattcccgttgtggctctcttgggcgcttctgaactgacaatagaagaatttttaagtttggaagtcggggactgtataactctggacaaatcagtgactgatcctcttactgtattggtcggaaacaaaccgaagtttttagggcaggccggccgggtgaatcgaagacaggcagtgcaaattttagatcacgacataagaggtgaacaagatgaacaatagattatctcaagatgaaatcgatgctcttcttaacggcacaagcagtcagtcagaggatacagaacagcctcaaggggcgaacttgtctgaacttgagcgcgatgcgatcggagaaatcgggaatatttcgttcggcagctcggctacggcgctgtccactcttttaaatcaaaaagtggacattacgacgccgagtgtgaccgtcatttcaaaaagcaaaatcagtgatgaatttcctcatccgtatgttgccattgaagtgaactacacagaaggctttgacggcagcaatttgctagtcgtcgaacaaagcgacgcggccatcatcgcggatttgatgatcggcggagacggccggggcgccgatccgtcactcggtgaaatccacctgagcgccgtgcaggaagcaatgaatcaaatgatgggctcggctgctacgtcaatgtcgaccgtattcagtaaaaagattgacatttctccgccaagggttgaacttctggatgtgacggaagaaaaagggaccgacagaatacctgaggatgacctgctcgtaaaagtgtcattccgtctgaaagtcggtgaattaatcgattcgagcatcatgcagctttatccgattacgtttgcgaaagatctgatcgcagaactgatgactgcagaccagcaagagtcagaggccgcagaaaccgtctcagaaccacaggaaacatacgaaacgccgcagccggaaccgcaggcaaaacctgagcttccgaagagacagggaaccgcaaaaaaagctgcgcctgttcaagtcgctccggtagaattccaggcgtttgatcataacgaagcggcgcaaggatcaaggaataaccttgatatgctgatggatattccgctttccgttacggttgagctcggcagaacgaagagaagcgtcaaagaaatccttgaactttctgcgggaagcattattgagcttgacaagctggctggtgaacctgttgacatcctggtcaaccagcggatcgtggcaaagggcgaggtcgttgtcatagaagaaaacttcggcgtgagagtcactgatattctaagtcaggcagaccgccttaacaatttaaaataagcgaacatagaggagagaaacagattatggcacacagaattttaattgtagacgatgcagcatttatgagaatgatgatcaaggatattttagtgaagaacggttttgacgttgtagctgaagcttcagacggagcgcaggcagtcgaaaaattcaaagagcattcccccgacctagtgacaatggatattactatgcctgaaatggacgggattacagctctaaaggaaattaaacagatcgatccgcaggcgaaaatcatcatgtgttcggctatgggccagcagtcaatggttattgacgcgattcaagccggcgcaaaagactttatcgtgaaaccgttccaagcggaccgcgtgcttgaagccattaataaaacattaagctaaagggtgtacgactgttgaaaaagagtcatggtttactagctttgatttgttgtttcgttttactcaatgtacatccgttccctgcttttgcggcggagtctgacaattccaccgtcaacgaatggtttgacaaacaatcaacaaacaaaacagagaaaaaaagcgatacatcgaaacaaacggctgatcaagagataggggatgcttctgcatcttctgtctccgcttttgattttgtaaagatgatcggggcgttattatttgtcattctgctgatctatggatttgtcaaactgatgaatagaagaaaccgtctgctgaagccgtttcaatatgtagaaaatatcggcggaacgtcagtcggccaaaaccgttccgtgcagctgattaaagtgggaaacagcgttctcgtagtcggtgtgggcgaaacgatacagcttttaaaagaaattgaagatgaaaaagagcgcgaggcgattctgagccaatacgaagagtcgatgtcttcaaaagtggaatggaccaagctcgtaaatccgcgtaaggatggagaaaaaaagccgcaaacgatgcttccgtcgttttcaaaagcgctgaaagaacagctgaacgagctgaaacaaagccgttctgaaggaaagaagaaaggcccttatcatcatgaatgaattcgttaatctttttaattcaagcagtccgaccgaagtcagctccactgttaaattactgctgcttttgactgtcttttcagtagcgccggggattctgattttgatgacctgctttacgagaatcgtcatcgttctgtcttttgtgagaacctcactggcgacgcagaacatgcctccgaaccaggttttaatcggccttgcgctgttcttgacgttttttattatggcgccgactttttcagagattaataaggaagccttaacgccgctgatggacaacaaaatcagtctcgatgaagcatatacaaaagccgagaagccgattaaagagtatatgagcaagcatacaagacagaaggatctggcgctgtttatgaactatgccaaaatgaaaaaacctgaatcgattcaggatattcctttgacgacgatggtccccgcttatgcgatatcagaactcaaaaccgcttttcaaatgggctttatgatttttattccgtttttaattatcgatatggtcgtggcgagcgtcttaatgtcaatgggaatgatgatgcttccgccggttatgatctctctgccctttaaaatattgcttttcgttttggtcgatggatggtatttaatcgtgaaatctttgcttgacagcttttagggtaggtgctaattgtgagttcagaatttgtaatttccatggcggaaaaagccgtatatgtaacactaatgatcagcgggccgctgcttgcgatcgcgctgatcgtcggtttgctcgtcagtatctttcaagcgacaactcaaatccaggaacagacgctagcgttcattccgaaaatcgtggcggtgatgcttggactgatctttttcggtccttggatgctgtcgacgattctttcgttcacaactgatctgttctctcatctgaaccgatttgcagggtagaatcaaatgaattccatcattgatttatttcccgcttttttattggtctttatcagaatctctgctttttttgtaacggtgccggtgttcggacatcggaatctgccggcggttcaccggatcggctttgctttttttctttcggtgatctgcttcagcacgctgaaacatgcgccggaaatagaaataggggaacagtatatgctgcttgtcataaaagaggccgttgtgggcttgagcctcgggctgattgctttcatgatgatgacagccattcagatagcgggttcctttattgattttcagatgggcttttccatcgccaatgtcattgatccgcaatcaggaacgcaaagcccgctgatcggacaattcgtttatacgctggcgctgttatttatgctcagcgtaaacgcccattatcttttattggacgggatttattacagctttcagtatatcccgcttgatcaggcatttccgtcgtttggaaatgatcactttgggctttttatcgcaaaaagcttcaatgccatgttcattattgcttttcaaatgtctgcgccggttgtggccagtctgtttttagttgatttggcgctcggtattgtggcgagaacggtgccgcagctgaatgttttcgttgtcgggcttcctctgaaaatagccgtgagctttattatgctgatcgtttgtatggcggtgatgtttgtcgtcgtccgcaacatcttcagccttaccgttgaaaccatgcggaatctattggcattggtcggtgtgacatgatgagactcagactgaatctgcaattctttgccggtgaaaaaacggagaaagccactccgaaaaaacggaaggatacaagaaagaaaggacaggtcgcgaaaagtacggatgtgaatacagccgtttctttactgattatctttctttcgctgatcgcgctcggtccttatatgcgggacaggctgctgtcctttattaaaacgttttatacgaaatcgatatcattacatctgtcagcatctgccgtgcatgaactgttcgtggatacggtgaaagatatcagcctcaccctcgcgccgattatgctggtcgcgcttgtggcaggtgtcgtgagcaattacatgcaggtgggttttctgttttctgcggaagtcctcaagcctgacttgaataagctcagcccgctgaaaggatttaagcggatttacagcatgagggcgattgttgaactggtcaaatccattttgaagattactgtggtcggttttgccgcctttatggtgctctggctgcattatggcgatattctccgccttccgcttttaacgcctgcggaagtgctcactttcgtttctaagctcacgctttggatggggcttgcgggatcaggggctctaatgctgctggccgggcttgattacttatatcagcgttttgactatgagaaaaatatcagaatgtcaaagcaggatataaaagatgaatacaaaaaatcggagggtgatccgattatcaagtctaaaattaagcagaagcagcgggaaatggcgatgaggcggatgatgcaggaagtgccgaaagcggatgtcatcattaccaacccgacccattatgcgattgctttaaaatatgatgaaaagaaaatggacgccccttacattgttgccaaaggggtcgaccatctcgcattaaaaatcaggcagatcgccaaagaacacgatgtcatgacgattgaaaacaggccgctcgcgcgtgcgttatatgatcaggttgacattgatcaggctgtgccggaagagttttttaaagtcattgcggaaattttggcttatgtatataaaacgaaacaaaaagtatagtgaatttcagattcaaaaggagagaaaaacagcatgtcaacaagagatttatcggttttaataagtgttgtcctcattgtggcaatgctggtgattccattccctccatggttgttaagtattttgatcatcattaatatctctcttgcgttgatcgtgcttctcaccacaatgaatatgcaagaaccgctgcaattctcgatattcccgtcattgctgctgttattgacgctgtttcggctttcgctcaatgtgtcgacgacacgttcgattctttctcacggagaagggggaaaggttgttgagacattcgggaatttcgttgtcggcggaaatgtgctggtagggcttgttgtcttcattatcttgattattattcagtttatcgtcattacaaaaggcgccgagcgggtatcggaagtggcggcgagatttacgctcgatgcgatgcccggaaagcaaatgagtattgacgcggatttaaatgccggcatgattacggagcaggatgcaaagcacagacgtgaaaaagtcgcccgggaagcggatttttacggcgccatggacggtgcgagcaaattcgtcaaaggggatgccatcgcggggatcatcatcgtgatgatcaatattattttcggaatcgtaatcggtatgctgcagcaggggatgagcatacaagaagctgcgtctcactttacaatgctgacggtcggtgacggtatcgtttctcaaatgccggccttgctcatttcaacggctacggggattgtcgtgacgagagcggcatctgaaggaaacctcggtcacgatattacaggccagctgtttgcttatccgaagctcttgtatgtagccgcgggaactgtacttttgctcggtcttcttacaccgatcggcattctgctgacggggccgatcgccggtctgcttgcattcggcgcttatatgctgtccaaagcggataagccgagcgaagaagaggaagaaattcttgaagaagaggctcaggcggatgaactgaaaagcccggaaagcgttgtgcagcttttacatattgatccgattgaatttgagttcggatacggactcgtgccgcttgcagacgcggggcagggcggtgatcttcttgaccgcatcgtcatgatcagacgtcagcttgcgcttgaattgggacttgtcattccggttgtgcgcatcagggataatatcgcgctccagccgaatgaatacagattgaaaattaaaggcaatgaagtcgctaaaggagagctcctgctggatcattacttagcgatgtcaccgacgcctgaagatgacgtcattgaaggcattgaaacgattgaaccgtcgttcggacttcccgcaaaatggatcagcgaagctgcaaaagatgaagcggacatgctggggtatacagttgttgatccggcgtcagtcgtatctacgcatattacagaaaaaattaagcagcatgctcatgaactggtcggcagacaggaaacaaagcagctgatcgatcatctgaaggaaaattatcctgtgcttgttgaggaagtcacgccgaaccctctttctgtcggcgatattcaaaaggtgcttgccaaattgctgagagaaaaagtttcaatcagaaacttggtgaccatttttgaaactcttgccgattacggaagattaacgacagattcagaccttttgacagaatacgcgagacagtcgcttgccaaacaaatcacggcacaatatgcgagagagcatgaaacgctgaaggtcatcacatgctcaggccgggtggaaaaagcgattgcagacggggtacagcagactgaacagggcaattacctgtcactcgatcctgaggtttcagacagcatcatccgttctgtcgctaaagaggccgagcagctttccatccgacaggagtcggcgattcttctttgctcgcctgctgtcagaatgtatgtaaaacagctgttagaacggtatttccctgatcttccggttctttcttataatgagctggaagcaaatgttgaagtacagagcattggagtggtggatatttaatgaaaataaaaaaatttacagccgcttcaatgcaggatgccgcgaagcaaatcaaaaaggaactcggcaatgatgccgttattttacattccaaacaagtaaagaaacgaaaatggctggggctgcggtcgcagcaggccgtcgaagtgatagcggttttagatcgtgacgtcagggaagcgagaaaaacgccgccggctgccgctggagaaatgaaaaagacggaaatggcggagaaagctgagcctgttcagccgccgcgtcttccggatcaaagtatttccggcgaacttgcgcatttgaaagaagtgctccctgaaccattaaaaaaagccgagagactattgaagcaagccgggcttcctgatcatacgcaaaacgccgtactcagtgaattgctcagttcttcaattgtttccggagatttaactgaagataatgtcagctcaaaactgcaggatttgttggtgaaaaaactcccttcggcagacaggtggcaggaagggattcaatcaaaatacgtcgtgcttttcggttcaaccggggccggcaaaacgactacacttgcgaaactcgcggcctcatcaatgctgacagagcataaaaaaattgcctttatgacgacggatacttaccggattgccgcggtcgagcagctgaagacatatgcggagctgcttcaggctcctcttgaagtatgttattcaaaggaagaatgtctgaaggcactggaaaaattcgctgaatatgaccatgttttcattgatacagccggcagaaactttaaagaagagcagtatattacggaattacaagagatgattccgtttgaatcaggcttacaatcttttctcgtattatcggcatctgcaaaatatgaagatatgaaacaggtgctgaaacagttttccggtgtgccggtcaatcaattcattttcacgaaaacggatgaaaccgcctcactcggctccgtgtttcaagtgctgtcggaatcaagaatcggcgccgcctatttgacaaatggacaggatgtgcctgaagacatcctatcggcttcaccaaaagagtttgtaaggatgcttttggcatgaaacccgatcaggcagagtcattaagaaggaaaatgagagagcggcaaatgatcaagccggagctttatgagaaaaaagcgaagacattagccgtcatcagcggtaaaggcggcgtcggaaaatctaatttaacattaaacatggcagttgccctgcaggaaaaaggaaaaaaagcactcatcattgatcttgacatcggaatgggcaacattgatgtgctgatcggcgctgcttcttcccgcaccattattgatgtgatggagaatcggcatgcattggctcaatcactttcctccggtccgaaaggccttcgctacatatccggaggaacggggcttgaggcgatctatcaagcagacagagagaagtggtcggcttttatgaatggtctttccgctgtattaagcgattttgattacgttctgtttgatatgggagcgggactttcaaaagaacagctgccgtttattttatcggcggaagacattctcgccgtgacaacgcctgagccgacggccattatggatgcctacagcgcgatcaaacatcttttgctcgcggatgaacggctgaccgtaaacattgctgtcaatcgcgcccgcgcccaaaaacaggcgctggacacgtacaaccgcctttctcatgcgattcacacgtttttaggcgcggaggtgcgtttcgccggctccatacccgatgatccgctagtaagtcaagccgtcattgaccaggtgccttttttaataaaaagtcctcaagcaaaagccagcaggtccgtccgtcttctgacggatgtcttgtttcaaacggaagaaaacaaaccaagagaagagaaaccggcatttattgagagattatcttcttttttattgaggaggactttacagtgattcgtgtgcttgtcgttgatgactcagcttttatgagaaagatgattaccgattttctggctgcggaagtgcagatagaagtcatcgggacagccagaaacggggaagaggcgctgaagaaaatagagcttctcaaaccggatgttgtcacgcttgatattgaaatgccggtcatgaacggaacggatacattgcggaagatcatcagcatatataaacttcccgtcatcatggtatcgagccagacacagcaagggaaggaccgaacgatcaactgcctggaaatgggcgcttttgattttatcaccaagccttccggatcgatttcacttgatctttataaaattaaagagcagctgattgagagagtgattgcagccgggctgtcccgcgcccaaaaacctgaggcggcagtgaaagagccttctatcccggaacgtccggctttggcgggatttgaaagaccgaaagcaaaatccgccaagcaggccgtattcatcgcgacctctacaggcggaccgcgtgccctgcaaaaggtgattccgaaactgccgaaggatttaaaggcgcctgtatttgtcgttcagcacatgcctgaaggcttcaccgcttcacttgcagacagactcaaccatttgtcagatattcaggtcaaagaagcggaaaacggtgaagaagcgaaagacggatgggtgtacatcgcgcccggcggaaaaaatatgacggttgcagaggaaggcggaaggctccgcatcattcttgacgttcatgatacggaaagccggcataaaccgtcagccgattatttgtttcggtcggcaagccgcttatccgattacgaaaaggtagccgtcattatgacaggcatgggcagcgacggaaccgaaggcgtaaaagaaatgctcagaacaggcggcgttaaaacgattgcggaatcggatgaatcctgtgttgtgttcggaatgccgaagtcagcgataaaggcgggcctcattcatgagattaaacatgtggaagatatcgcggcatccatcaccggatgtgtgaaaaaagagagggtgtgaatcaattggatatgaatcaatatttagatgtctttattgatgaaagtaaagagcacttacagacatgtaacgaaaagctgctgctgttggaaaaagatccggcagaccttcagcttgtgcatgacatcttcagagctgcccatacgctgaaaggcatgagcgcaacgatgggatatacagatctggcgcatttaacccacctgatggaaaatgtgctggacgccatccgcaacggagaaatgcccgttacatcggattggctggacgtgctgtttgaagcgcttgatcatcttgaagagatggtgcagtccattattgacggaggagacggcaaacgtgatatttctgaagtaagtgcgaagctcgacgtaaatgcggtgcatgagactgcggcttcagccgaaacagcagaaccgccggcttcaaaacaacagacttcaactgaatggaattatgatgagttcgaacggactgttattgaagaggcggaagagcaaggattcagccgctatgaaataacggtttccctgaatgaaagctgcatgctcaaagccgtgcgcgtgtacatgatatttgaaaagctgaatgaagccggggaagtcgcaaaaacgatacccgccgcggaagtacttgagacggaagatttcggaacggattttcaggtgtgtttcttgacaaagcagcctgctgaagaaattaaagaactcatcagcggcatttcagaagtggagaaagtcgaaatttctgccggtgcgccgttaaaaacggccgaaaaaccgcaagcggttgaaccggtgaaggaaactccggttaaaaaggctgaaaaacagccgaagccgcaagcgaaaacggaagaacagccgaagcatcacagcggctcgaaaacgattcgtgtcaacattgaaaggctggattcttcaatgaatctttttgaagaacttgtcattgaccgcggacgtcttgagcagatcgccaaagagcttgaccacaatgagctgactgaaaccgttgaacgcctgaccagaatttcgggcgaccttcagtctattattcttaatatgcggatggtgccggtagaaaccgtctttaaccgtttcccgagaatgatccgccagcttcaaaaggaattaaacaagaaaatcgaattgtccatcatcggagctgaaacggagctggaccgcacggtgattgatgaaatcggcgatccgcttgtgcatttaatcagaaacagcatcgatcacggcattgaatcgcctgaagtgcgggtgaataaaggaaaaccggaatcgggtcatgtcgtgcttaaggcatatcacagcggcaatcatgtctttattgaggttgaagatgacggggccggcctgaacagaaagaaaattcttgaaaaagcgctcgagcggagtgtaatcaccgaacgtgatgctgaaacgcttgaagataatgagatttacgagcttatttttgctcctggcttctcgactgccgatcaaatttctgacatttcaggtcggggcgtcggtctggatgtcgtaaaaaataaactcgaatcactcggcggctctgtcagtgtcaaatccgcggaaggtcaaggttctcttttcagtatccagcttccgctgacactttcaattatatccgttcttctcattaaactggaagaagagacgtttgcgataccgatttcttctattatagagacggctgttattgataagaaagatatcctgcagacgcatgacagagaagtgattgatttcagaggccaaatcgttccgatcgtctatctgaaaaaagaattcggcattacggattcaaaacaggatgccgatcagttccatgtaatcgtcgtgaaaaagggcgataaatccactgcttttgtcgtggactcttttatcggacagcaggaagtcgtactgaaatcactcggcgactatttgacgaacgtctttgcgatttccggcgctacgattctcggaaacggagaagtggcgctgattattgattgcaatgcgctgatctactaaaacgacacgaggaggtgcccgcatgactgctgaaatcaaaacaggtgaaaaaatgattgtgtttatgataaacgggaaagaatacgctatctcagtttcccaggtgaaatcaattgaaaagtggcaaaaaccgacgagggtcccgggggtggaatcttatatccgcggcgttatcaatctacgcggagtgattaccccggttcttgatttaagaaaacgtctgaaccagcctgaacaggacatcacagaagagacacggattatcatcatttcttaccgtgacgccgatgtcggatgggtcgtggatgaggccaatgacgtcatcaccgtgcatgaaaatgaaattgaatccgcgcctgaaagccagacaaaggaaacggatgtgtggattaaacagatcgtcaagcaagataacaggctcctcaatattatcgatgcgcatgcggtgctggataaaggtgcttcggcatctgcgtccggagagccgaatgcttaaaggggaaaagacaacatgagtaagtttgaagcgatcaaagaagagcagatggatattttgcgggaagtcggaaatatcggggcgggtcactcggcttctgccatggctcagctgctgaacagaaagatagacatggaagtgccgtttgcgactttattgacatttgatgagctcgctgattttttcggcggggctgaaacgccggtcgccagtatctttttaagaatggaaggcgacatgaccggttctatctttctcatcatgccttttgatcaagcggaacagtttatcagagagctgatcggaaatccggattttgatattgaccagttgggtgaagatcatttgagttcttctgctttacatgagttcggcaatattttagcaggctcctatttaacggcattggctgatttgacaaagcttgagatttacccgagcgtgccggaaatctcacttgatatgttcggcgcggttatcagtgaaggactgatggagctcagccaagtcggagagcatgccattgtcgtggatacttctatttttgaccagggcagccggcaggagctcaaagcccacatgtttatgctgccggactatgattcttttgaaaagctcttcgtctcattgggtgcggctttatgagccgtgcggaagccgcagtcgttaaagtggggattgcggatgttcaagtcgcgcgttacccagataaaatccgaacctcgggactcggttcatgcgtggggctggttttatacgataaagacaaacaaacggcaggactcgttcacgtcatgctgccggactccggtttatcaaaaacggcggagctcaaccgtgcaaaatacgcggacaccgccgttaagatgacgattgatatgcttttgaaagccggctgccgcaagtttgccctgaaggcaaaactcgccgggggagcggagatgtttaagtttaaaatgacaaacgacctgatgaaaatcggtccgaggaatgtagcggccatcaaagagcagctttcattgtataacattccggtcatcagtgaagatacgggcggctcaagcggccggacgattgaatttgagccaaagtcctgcatgctgcacattcgaactgttaaacaaggtgaaacaacgatttaataaaggtatgaggtagggggataacaatgcaatccttgaattatgaagatcaggtgctttggtcgcgctggaaagagtggaaagatcctaaagccggtgatgatttaatgcgccgttacatgccgctggtcacatatcatgtcggcagaatttccgtcggactgccgaaatcggtgcataaagacgatctaatgagccttggtatgcttggtttatatgatgccctggaaaaatttgaccccggccgggatttaaaatttgatacctatgcctcgtttagaattcgcggtgcaatcatcgacgggctgcgtaaagaagattggctgcccagaacttcacgggagaagacaaaaaaagtcgaagcggcgatcgaaaaacttgaacagcgctaccttcggaatgtgacgccttcagagatcgcagaagagctggggatgacggagcaggacgtagtatcaacgatgaatgaaggattttttgccaatctcttatcaattgatgaaaagcttcacgaccaggatgacggtgagaatattcaagtgatgatcagagatgacaaaaatgtgccgccggaagaaaaaatcatgaaagacgagctgatcgctcagctggcgggcaaaattcacgagctctctgaaaaagagcagcttgtcgtcagtttattctataaagaagaactgactttgaccgaaatcggacaagtcctgaacctttagacgtcgcggatttcacagattcattcaaaagcgctgtttaaattaaagcacctgcttgaaaaagtaattcaataatgaactcatggttagcgagtgaaaaacatgtcaacactattatggcttttaagctttgtgcttcacggcgtactgctttatgccgtcattattctgtacacgaggttttcagccctcaaggagacggagcgccagcagaagaagattcttgaagagacggaaaacactcttgcagcgtttctgcttgagctgaaagaagaaaatgaaagactcgaagacgcaaaaaaccggaatgatcaagcacctgacgcagaagacgccgaaccccggccggaaccgaaaaaagagcctgatattccggaccatatggaaaagctcatcagtgcaacggaacgggctgaaagtgatgaaaacagcggcgcgcattcgtttgaagaacgtgtttcagaattatatgaacaagggctcacccccgcggaaatcgccaaacgggtgcagagcggaaagacagaaatcgagctgtttttaaaatttcgcggcaaagctgtaaaggattcttgattgtcgcataaagctgtgttatattatgtcttggtgttaaatacacacgcttaacgatttatgcagagggtgctgcaaacggcagttctgcacaaaaatgacctaagcggaggaaaaaaaccattttattaggaggaaatcacatgtcagttatttctatgaaacaattgcttgaagctggtgttcacttcggccaccaaacacgccgctggaacccaaaaatgaagcgttacattttcacggagcgtaacggaatctacatcattgaccttcaaaaaacagtgaaaaaagtagaggaagcttacaacttcacgaaaaaccttgctgctgaaggcggaaaaatccttttcgtcggcacaaaaaaacaagctcaggattctgttaaagaagaagctgtacgctctggcatgtactatgtcaaccaacgctggttgggcggtacactgacaaacttcgaaacaatccaaaaacgcattaagcgtctgaaagacatcgagaaaatgcaagaaaacggtacatttgaagtacttccgaaaaaagaagttgttcaattgaaaaaagaattagagcgtcttgaaaaattcctcggcggaattaaagacatgaaggatcttcctgatgcattattcatcatcgatcctcgcaaagagcgcatcgctgttgcggaagctcgcaaattgaacattcctatcatcggaatcgtagatacaaactgtgatcctgatgaaattgatgtcgtaatccctgcaaacgatgacgcaatccgcgctgtcaaacttcttacttctaaaatggcagatgctattcttgaagcgaagcaaggcgaagaagaagcggaagctgctgaagagactgcacctgaaacagaaacgacaactgcgtaacctaatcaaaaggtgataagagggactgccttttatcaccttttttcaagaaaaatgtatctatacatatcttgtttacacatataaggaggaattcaaatggctattactgcacagcaggtaaaagaactgcgtcaaaaaacaggcgctggtatgatggactgtaaaaaagcattgactgaaactgacggagatatggacaaagcaatcgaccttctgagagaaaaaggaattgcgaaagcggctaaaaaagctgaccgtatcgctgctgaaggttctactcttattaaaactgacggcaacaaaggcgttatcttagaagtaaactctgaaactgatttcgttgcgaaaaacgaaggcttcaaagagcttctgaacacgcttgctgaccaccttcttgcaaacgctcctgctgatcttgaagaagcgatgggtcaaaagatggaaaacggttctactgttgaagaatacatcacaagcaacgttgctaaaatcggagagaaaatcactcttcgccgttttgctgttcttacaaaagaagacagcgaagcgttcggtgcttaccttcacatgggaggccgcatcggcgtattatccgttcttagcggaacaactgacgaagatcttgcaaaagacatcgcgatgcatgttgcagcggtaaatcctcgttatatttcccgcgaccaagtgtctgaagaagaagcaaaccatgagcgtcagatcctgactcagcaagctcttcaagaaggcaaaccggaaaacatcgtagctaaaatggttgaaggccgtctgaacaaattcttcgaagaaatttgcttattagaccaagctttcgttaaaaacccagacgaaaaagtgaaacaagttgtggctgcgaaaaacgcatctgttaaaacttacgtccgctacgaagttggagaaggcattgaaaaacgccaagaaaactttgctgaagaagttatgaaccaagtgaaaaaataatggcggaaagccttggcgaatctttcgcggcttttcaggcagtataggggacactacttgtgttccctatttttaaaactatatttacaaacctttttttctcttgcataataggaaacggcaatgtttacacttggaggttattatggaaaaaccaaaatacaatcgtatcgttttaaagcttagcggagaagcattggcaggagagcagggaaacggcattaatccgactgttatccaatccatcgctaaacaggtaaaagaaatcgctgagcttgacgtcgaagtggccgtagttgtaggcggcggcaacttatggcgcggaaaaacaggcagtgacttaggaatggaccgtgcgacggccgattatatgggcatgcttgctactgtcatgaactcacttgccctgcaggacagcctggaaacgctcggaattcagtccagagtgcagacatcaattgaaatgcgtcaggtcgctgagccttacatcagaagaaaagccatccgccacctggagaaaaaacgcgttgtgatttttgccgcgggaacaggaaacccttatttctctacggacacaaccgcagcgctgcgtgccgctgaaatcgaagcggatgtgattttaatggcgaaaaataatgtcgacggtgtgtataatgccgatccgagaaaagatgagtcagctgttaaatacgaaaaattatcttatctcgatgtgttaaaagacgggctggaagtcatggattctacggcttcttcactatgtatggataatgatattccgctgatcgtcttttctattatggaagaaggaaatattaagcgtgccgtaatcggcgaatcaatcggaacgatcgtaagggggaaataacgttgtcaaacgaagtattaacacaaacaaaagaacgcatggaaaaagcggttgctgcttattcacgtgaattggcgtcagtccgcgcgggacgtgccaacccatctctattggataaagtgacagtagaatactacggtgcccaaacacctttaaaccagctgtcttccatcaatgtgcctgaagcgcgtatgcttgttgtcacaccgtatgacaaaacggcaatcggcgatattgaaaaagcgatcctgaaagctgatcttggcgtaactccgacaagtgacggaacaattatccgcatcgcgatcccggctctgacggaagaaagacgtaaagaacttgtcaaagtcgtgaaaaaatacgcggaagaagcgaaagtagcagtccgtaatgtccgccgtgacagcaacgatgacctcaaaaaacttgagaaaaacggggacattacagaagacgagcttcgtgcttccagtgaagacgttcaaaagctgacagatgaatatgtgtcaaaaattgacagtgtcacgaaggacaaagaaaaagaaatcatggaagtttaatgaaaaactatgtacaatagataatgtgaaaagaccctctcatgtttacagggggtttttttgttaatactgttgattacattgatcatcagcaacgcaacctttttgggtgacggaggaatctcatgctcaacatactcaaaaattggaagaatcagcagaatgcggcttccaacttagaacggtatacaaaagaagacatactgaagggtgaaattcccgcacacattgccattattatggacggaaacggacgctgggcgaagaagcgctcactcccgcggattgccggacatcatgaaggaatgaaagtggtaaaaagggtgacaaagctcgcaaatcagctcggcgttaaagttctgactctttatgcgttttcaactgagaattggaagcgcccgaagatggaagtcgactttttgatgaagcttccggaagagttcctgaatacgtatcttcctgaattgatagaggaaaatgtacaggtgaaaattatcggagatgaatccgcgctcccttctcatacgtacagggcgattgagaaggccgtaaaagatacagaacaaaatgacgggctgattctcaatttcgctttgaactacggcggacgcacggaaatcgtcaatgcggcaaaagcattggccgaacaggtgaaaagcggcacgctgaatatcgaagacattgatgaagcgctcttttccgggcatttaatgacagaatcaatccaggacccggagctgctcatcagaacgagcggagaaatcagactgagcaactttatgctttggcaggtggcttacagtgaatttgtttttacagatgtcctgtggcccgattttaaagaagatcactttctgcaggcagtgggagaatttcagcagcggggccggaggtttggcggaatttagaggatggtggaaatgaaacaaagattgttaacaggtgttctggcagcggcactatttttatttttggttattttcggaggattgccgttcaccgtatttgtttacgtgatgggaagtatagcgctttttgagcttttgcggatgaaaaagctcagatttttttcttttccgggtctgatcagcctcttattgttatgggtgtatatgatgccggacaaatatcattttttcgatgcgaaaatggaagtaacgattttcgccgtattgattctgctcagctatacggtgctcgtgaaaaacacctttacgtttgacgaagtcgggtttatcgttctcgcgacggtatatatcggactgtgttttcattattttattgaaatcagaaacattgaaacaaacgggcttttgtatatcttttatgcctgcgttgtcatatggtcaacggactcaggcgcatatttcgtcggaaagtcgctcgggaagcggaagctgtggcccgaaatcagtcccaacaaaacggtggaagggtttctcggcggtattgtcatcgcccttatttttacggctgtttttcagctgtttgcgcaccttccgatttcatacctggttcttttggtcatcacgcttgttctgtctgtgttcggacagatcggggatttggttgaatcagcgcttaagcggcactatgatgtgaaggattcggggaaaatccttcccgggcacggcggcattttagaccgatttgacagctttttgtttgtcatgccgttcttatactttctgcttgcgcttttttcatgagaaaggctaatatgaaaataagaccgatctggacgcatagaatgggagtggcattttgaagaatatttgtcttttaggagcaacaggatcaataggggagcagacgttagacgtattgcgcatgcatcaagatcagttccgtctcgtctcgatgactttcggtaaaaacgccgagaaagcgatcccgttgatcagaacgtttcagccgaaatatgtagcagtcggcgacatggatacatatcaaaaagtgaaagaagcgtctttttctcatgaatgccaaatcggcatcggagaagaaggcctgattgaagcggcagtcatggacgaagtggatatcgtggtcaatgcgctgcttggaagcgtcggtttaatcccgactttgaaagcgattgaacagaaaaaaacaattgcgcttgcaaataaggaaactctcgtcactgccgggcatatagtgaaaggacacgcaaaacgatacggtgttcctcttcttccggtcgacagcgaacattccgctatttttcaggcgctgcaaggcgaacagagcaaaaatatcgagcgcctgatcattacggcatccggcggcagtttcagagataaaacgcggcaggagcttgagtctgtaacgattgccgacgcccttaatcacccgaactggtcgatgggtgcaaagattacgattgactcggctacaatgatgaataaagggcttgaagtcattgaagcgcattggctgtttgacattccgtatgaacagattgacgttgtattacataaagagagcatcattcattcgatggttgaatttcacgacagaagcgtcatcgcccagcttggaaatccggacatgagggtgccgattcaatacgcgctgacatatccggaccggctgcctctgcctgaagcaaaaaggcttgaattatgggagatcggaagccttcattttgcgaaagctgactttgaaaggttccgctgcttacaatttgcctttgaatcaggtaaaatagggggaacgatgccgacggttttaaatgcggccaacgaagaagccgttgccgcttttcttgccggacggatttcattcttatcgattgaggacctgattgaaaaagcattggaccgccacagcgtaattcaggatccgagtcttgcggatatccaagaagtggacaaagacacccggggatacgttaattcaatactcacataaggtggtatgttcgtgaatacagttatcgcgtttattattattttcggaacgctcgtttttttccatgagctcgggcatttattgctcgcccaaagagcgggaatcctttgccgtgaatttgcgatcggcttcggccctaaaatcttttcatttaaaaagaatgaaaccgtgtatacgatcagactccttccggtcggagggttcgtccgcatggccggtgaagacccggagatgatcgaagtcaaacccggttataccgtcgggcttctttttaataaagaggacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctctttttttatcgtagacggagaagaagtgcagattgcgccttacaatcgacaattcgggtctaaacccgtatggaagcggattaaggcgattgctgccggtccgataatgaacttcatcttagcgtatgtcattctcgtcatgctcggatttattcaaggcgtgccttcgaatcagcctgagctcgggaagctgacagacaatggacgcgcagctgctgccggtttaaaagaaggcgactatatccagagcattaacggtgaaaaaatgaggtcatggaccgacatcgtgacagctgtaaaagaaaatcccgggaaaaaaatcgatgtcgccgtcaaacgggacggcaaatcgtttcatatctcggttacacctgaagctgtaaaagatgaaaataaaaaaacaatcggccgcttcggctcttatgcgccgactgaaaaaggcgcgcttgcagcgattgcttacggcgcgacatctaccgttgatgttacaaaagcgatcctgaccaatctgagcaaacttgtgacaggccagtttaagcttgatatgctttcgggccctgtcggcatttatgatatgacggatcaagttgcaaaaaccggtattatcaacctattccagtttgcggcgtttttaagcatcaacctgggaatcgtcaacctgctgccgataccggcgcttgacggcggacggctgctgtttttattcattgaagcaatccgcggcaagccgataaaccgtgacaaggaagcatttgtcgtatttatcggcgtagctttcttaatgcttcttatgctggttgtcacatggaacgatatccagcgtttattcttataattgactagtaaaaaatcagaggtgcgaagacatgagacaaagtttgacgcttattccgaccctgagagaagtgccggctgatgctgaagcaaaaagccataagcttctgctgagagcgggatttatcagacaaaatacgagcggggtttacagctacatgcccctggcttacagggtcattcaaaacattcagaagatcgtgcgtgaagaaatggaaaaaatcaacgcggtggaaatgctgatgccggcccttcagcaggctgaaacatggcaggaatcaggcagatggtatacgtacgggcctgaattaatgcgtctgaaagaccgccacggccgtgaatttgctttaggcgcgacacatgaagaagtcattacttctctcgtgcgcgatgaggtgaaatcttataagcgtctgccgctcactctttaccagatccagtctaaattcagagatgaaaaacgcccgcgtttcgggttattgcgcggacgcgaattcatcatgaaagatgcgtattctttccatgcttctgaagaaagtctggaggaaacgtaccaaaacatgtacggcgcatacagcagcattttcgcacgctgtgaattaaacgtccgtcccgttattgccgactcgggcgcgatgggcggaaaagacacgcatgaatttatggctctttctgaaataggggaagataccatcgcttattccgatggatcctcttacgcagccaatacggaaatggcggaagttgtcatgaacagcgagccgtcagatgaaacacccgaggcattggagaaaattgatacgccgaatgtcaaaagcattgaagagctcgcttcgttcttgcatattgagccgagcgcctgcatcaaatcaatgctgtttaaagcggatgaccgatttgttctcgtgttagtaagaggcgatcatgaggtcaatgacgtgaaagtgaaaaaccttctgaacgcggaagtggttgagcttgcgtctcatgaagaagtagcggagaaacttggcgcggagccgggatttgcggggccgatcggcgctgccggcgacattgagatttatgccgaccaagccgtgaaagtaatggtaaacgccgtttgcggcgcgaatgaaaaagaccgtcattaccgaaacgtaaacatcgaacgtgacgcgtctgtaaaagcatacgccgatcttcgaatcattcaggaaggcgatccgtcacctgacggaaaaggcacgatccgtttcgctgaagggattgaggtcggacaagtctttaaactcggcacgcgttactctgaagcgatgaatgcgacataccttgatgaaaacgggcgtgcgcagccgatgctgatgggatgttacggaatcggcgtgtccagaacgctttcagccatcgctgaacagcatcacgacgaaaaaggcttgatctggccgaagagcgttgctccgtatgatcttcatattttggcgctgaatatgaaaaacgaagcgcaaaaagagcttgctgaacagctttacggcaaattccaggcggaaggttatgaggtattatacgatgaccgcgctgaacgcgcaggcgtgaagtttgctgattctgatctgatcggccttccgatccgcatcactgtcggaaaacgtgccgacgaaggcatcgtagaagtgaaaatccgcaaaaccggtgaatctgccgaagtttcagtggatgagctttctgaatttattaagacgaagtaatcaccataacgaatcgtccaaaatcatgttaaaatagagaaaaaagaaggtacctcatcacctgcggaggtaccttcacttatgatgttttaagggagggatactgtctgaatggaacagttatcagtaaacagaagacagtttcagattcttctgcagcagcttaatatgacagatgataccttcatgacatactttgaagacggagagattgataaactgacaatccataaagcagaaaaagcctggcatttccaatttcgctttaaggctcttttgccgtatcaaatatatgattcattcatgatgaggttaacacaatcgtttgctcacatcgcccgtgtcacatcgtctgttcaggtcatcgatcctacagtgacagaggagcttgtacaggattattggacacgctgtattgaagagcttgaaggaacctcgccgccgatggtggctcttttgaatcagcagaagccgaagctcaagggaaacaaactgatcgtgaaaacaaaaacagatacagaagcatcggcgctcaaaaataaatacagcacactgattcagcacagctaccgccaattcggatttccggaactgcagctggataccgaaattttcgtatctgaccaagaagtccagaaattccgcgagcaaaagcttgctgaagatcaggagcgggcgatgcaggcgcttatcgaaatggagaagaaggaaaaagagggcgatgaggatcaagcgccgtccggcccgcttgtcatcggctatcaaattaaagagaacgaagaaatccggacgcttgacagcatcatggatgaagaaagaagaattacggtgcaggggtttgtgtttgatgctgaaacacgcgagctgaaaagcggacgcacgctctgcattttcaaaatcacggactatacaaacagcattttagtaaaaatgttcgccagagaaaaagaagacgccgctttgatgaaaacgctgaaaaaaggcatgtgggtgaaggcgcggggaagcattcaaaacgatacattcgtcagagacctcgtcatgattgcaaatgacgtgaatgaaataaaagccaaaacccgtgaagacaccgctcctgaaggcgaaaaacgggttgagcttcatctgcattctccgatgagccaaatggatgctgtaacgggcatcggaaagcttgtcgaacaggcgaaaaaatggggacatgaagcgattgcgttaactgatcacgccgttgtgcagtctttcccggatgcctattccgccgcgaaaaaacacggcataaaaatgatatacggaatggaagccaatatcgtggatgacggcgttccgatcgcatacaatccagctcaccgtctcctggaagaagacacatacgtcgtctttgacgttgaaacgacaggtctgtccgcagtgtatgacaccatcattgagcttgccgcagtcaaaataagaggcggagaaatcatcgataaattcgaagcgttcgccaatccgcaccatccgctgtcagcaacgacgatagagcttaccgggataacggacgacatggtccgcgacgctcccgatgtcgttgacgtcgtccgggattttaaagaatggatcggcgatgacgtgcttgtggctcataacgccagctttgatatgggatttttaaatgtggcgtacaagcgtcttttgaaaacggaaaaagcgaaaaatccggttattgatacgctggaactcgcgcgtttcctgtatcctgagtttaaaaatcaccgcttaaatacgttatgtaagaagtttgatatcgaattaacccagcatcaccgagcggtctttgacgctgaagcaacgggctacctgctgttgaaaatgctcaaagatgccgctgaaaaagacattttttatcatgatcagctgaatgagaatatgggacaatccaatgcttatcaaagatcaaggccttatcacgctacattgcttgccgtaaatgagaccggccttaaaaatctgtttaagctcgtgtccatttctcatattcaatatttctacagagtgccgcgcattccgaggtcgcagcttaataaatacagagaaggtctgttaatcggctctgcctgtgacaggggagaggtctttgaaggcatgatgcaaaaatcacctgaagaggttgaagatatcgcatcattctatgattatcttgaagtgcagccgccggaagtatacagacaccttctgcagcttgagctcgtccgggatgaaaaagcgctgaaagaaatcatcgccaacatcacgaagctcggggaaaaattgaataagccggtcgttgccaccggaaatgtccactatttaaacgatgaggacaaaatttaccggaagatcttaatatcttcccaaggcggcgccaacccgttaaaccggcacgaactgcctaaagtgcacttcagaacgacagatgaaatgctggatgctttctcctttctcggtgcggaaaaagcgaaagaaatcgtggttgacaatacgcagaaagtcgcttcgatgatcgatgagatcaaaccgatcaaagacgatctgtacacgccgaaaattgacggagctgatgaagaaatccgtgaaatgagctatcagcgcgccagaagcatttacggtgaagagcttcctgaaattgtggaagcgagaatagaaaaagaattaaaaagcatcatcggtcatggattcgccgttatttatctcatctctcataagcttgtaaaacggtctctggatgacggttatctcgtcggctcccgggggtccgtcggttcatcgcttgtggcgaccttaacggaaatcactgaagtgaatccgctcgctccgcactatgtgtgcccgagctgccgatattccgaattctttaatgacggatcagtcggttccggttttgaccttccggataaaagctgcccgtcttgcggcacacctttgaaaaaggacgggcatgatatcccgtttgaaacgttcttaggctttaaaggtgacaaagtacccgatatcgacttgaacttctcaggtgagtatcagccccatgcccataactacacgaaagtgctgttcggtgaagataacgtgtatcgcgcgggaacgatcggcaccgttgcggaaaagacggcttacggatatgtgaaaggctatgcgggtgatcacaacctacacatgcgcggcgcggagatcgaccgtctggtgcagggctgcaccggcgttaagagaacgaccggccagcacccggggggattatcgttgtcccggattacatggatatttacgatttttccccgatacaattcccggcagatgcgacggggtctgaatggaaaacgactcattttgacttccactccattcatgacaacctgctgaagcttgatatattggggcacgatgatccgacagtcattcggatgctccaggatttaagcggaattgatccgaagacgattccgacagatgatccggaagttatgaagattttccaaggtacagaatcgctcggcgtcactgaagagcagatcggctgtaaaacggggacgctcggtattcctgaattcgggacgcgatttgtgcggcagatgcttgaggatacgaagccgacgacgttctccgagcttgtccagatttccgggctttcccacggaacggacgtatggctcggcaatgcgcaggaactgatacacaacaatacgtgtgaactgagcgaagtgatcggctgccgtgatgacattatggtttacttgatctatcagggccttgagccttcactggcctttaaaatcatggaattcgtgcgtaaaggcaaaggcctgacgccggaatgggaagaagaaatgaaaaagaacaatgtgccgaactggtatattgattcatgcaaaaaaatcaaatacatgttcccgaaagcccacgccgccgcatacgtattaatggcggtgcggattgcatactttaaagtgcatcacgcgcttttatattatgctgcgtattttaccgtccgcgcagatgactttgacattgatacaatgattaaaggctcgaccgccatcagagcggtgatggatgatatcagctctaaagggcttgatgcttcgccgaaggagaaaaacctccttaccgtgttagagcttgcgcttgaaatgtgtgagcgcggctattccttccagaaggtcgatctataccgttcgagcgcttcggaatttatcattgacggcaacagtctcatcccgccgttcaactcaattccgggactcggaaccaacgccgctctcaatattgtgaaagcgcgggaagaaggggagttcctttcaaaagaggatcttcaaaaacgcggaaaagtgtcaaaaaccattttagagtatttagaccgtcacggctgtcttgagtcgcttccggaccaaaatcagctgtctctgttttaagctttgtgcacagcctccgagcggagttagatttgcattaaatatatggttatggtatagttttattggaaatgctaacgattaccgaggcaaagagtggggaaacccgctcttttgtattgaacaggcaattttgcctcgacatgtccatcgttttctcaatgcccctgctcttttgaagcagggtttttatgcagaggaacggctgatatgatatcgacagcacaaggaggaaaaacatgagcaaaaaagtgactgataccgttcaaggaatggctcagcccatactggatgaccttcagcttgaactcgtagacattgaatttgtcaaagagggtcaaaactggttccttcgcgtgtttattgattccgataacggtgttgatattgaggagtgcgccaaagtcagcgaagcgttaagcgaaaagctggatgaggccgatccgatcactcagaactactttcttgaagtatcttctcctggagccgagcgtccattaaagaaaaaagccgacttcgaaaaatcactgggcaaaaatgtgtacatgaaaacgtacgaaccgattgacggtttaaaagtgtttgaaggcaaattggctgaatttgatggacaaactgttacaatagagatgacggtcaaaacaagaaagaaacgggtcaatattccgtatgaaaaaatagctaacgcgagattagctgtaacattttaatgaatgaagtattagtgtttaaggggggagaccgctaacatgagcagtgaactattagatgctctcactattcttgaaaaagaaaaaggcatcagtaaagacattatcatcgaagcaattgaagctgccttaatttccgcgtataagcgaaattttaaccaggcgcaaaacgtacgggtcgatctgaaccgtgagacgggcacgatccgcgtgttcgcaagaaaggatgtcgtagacgaggtatacgattcaagacttgaaatctcgcttgacgacgcccagcacatccatccgaactaccttgtcggagatgtcgttgaaatagaagtaacgccgaaagacttcggccgcattgctgcgcagacggcgaaacaagtggtgacgcagcgtgtccgtgaagctgagcgcggcgtgatttactcagaatttatcgatcgtgaagaagacatcatgacgggaattgtacagcgcttagacagcaagtttatttacgtgtctctcggcaagattgaagcgctgctgcccgtcaatgaacaaatgccgaatgagagctataaaccgcacgatcggattaaagtatttatcacaaaagtcgaaaaaacgacaaaagggccgcagatctatgtatcaagaacgcatcctggcctgttgaagcgtctttttgaaatcgaagtgccggaaatttatgacggaacggtcgaactgaaatccgttgccagagaagcgggcgaccgctctaaaatctccgtccgcactgatgaccctgacgttgatccggtcggttcatgcgtcggtcctaaaggccagcgggtgcaggcgatcgtcaatgaactgaaaggcgaaaaaattgatatcgtcaactggtctgatgatccggttgaatttgttgccaatgcgctcagcccgtctaaagtgctggatgtcatcgtcagcgaagaagaaaaagccacgactgtcatcgttcctgattaccagctttctctggcaatcggaaaaagagggcaaaacgcccgcttagccgcgaaattgacaggctggaaaatcgatatcaaaagtgaaacggatgcaagagaccttggcatctatccgagagagcatgaagaagatgacgatttagagccgctctttatggagcctgaaacagccgaatcggatgaataagaggtgactttaggtgaataagcgaaaaaaaattcctctgcgcaaatgcgtggtaacgggggaaatgaagcctaaaaaggaactgatccgaattgtccgttctaaagaaggagagatttcagtcgatccgaccggaaagaagaacgggcggggtgcctatatcacccttgagaaagaatgcatcttagctgcgaaaaagaaaaacacattgcaaaatcaatttcaatcacaaatcgatgaccagattttcgaagaattgctggaactggcggaaaaggtgaaaaaataacatgtctggaatggaatggtttcccttgctgggtctggccaatcgagctcgtaaggtcgtgtcgggcgaggacttggttataaaagaaattagaaatgcgcgtgcaaaacttgttctgctgacagaagatgcatctgcgaatactgcaaaaaaagtatccgataaatgcaattattataaagtgccttataaaaaagtcgaaagccgcgcggatctcggccgctctatcggcaaggaatcacgtgtcgttgtcgccgtcactgaccaaggttttgcgaataagctgatcagcttgctcgattaatatttttgggggtgaacgaatggctaaaatgagagtttacgaatatgcaaaagccatcaatgtttcaagcaaggaaattttgactgcgctgaaaaacatggatatagtagtaaataaccatatggcaatgcttgaagaaaagaccattaagcagcttgatgcgaaatttaaaaaaggcggcgccggcgttacatctcagaagcctgcggaaacgaacaaaaacaagccgcaagggattaatcagcagcctgctgggaatcaaccaaacaaaattcgagacggaaagaagaatgacgtgcagaataatcaatttaacaaaaacaagaagaacaacaacaacaaaaacaaaaacaaacgcaatcataacaacaaaaatcagtatcagcaaaaaccgctgaaaccgaaaaaagagcttcctgagaaaattacgttttccggctctttaacagtcggggccttagccgaagaacttggcaaagaaccgtctgaactcattaaaaaactgatgcttctgggcgtaatggctacgattaaccaggagcttgacaaagacacaatcgaactgatcgcatctgaatacggtgtggaaacagaagaagtgattgtgctcgaagaaactgagcttgaaaagtatgaagaggctgacaaagaagaagatcttcaaacccgtccgcctgtcgtgacgatcatgggccacgttgaccacgggaaaacgacccttcttgacagcatcagaaaaacaaaggttgttgaaggtgaagccggcggaatcacccagcatatcggggcgtaccagatcgaagaaaacggcaaaaaaatcacgttcttagatactccgggacacgcggcgttcacaacaatgcgtgcgcgcggtgcggaagtaactgatattaccattttagtcgtagcggctgatgacggcgttatgccgcaaacagtcgaagccatcaaccatgcgaaagcggctgaggttccgattatcgttgccgtgaataaagtggataaagaaagcgcgaaccctgaccgtgtcatgcaggagctgactgaatacggactcgttcctgaagcatggggaggagaaacgattttcgttcctctgtccgctcttacaggcaagggaattgacgagcttgtcgaaatgattctgcttgtcagtgaagtggaagagctgaaagccaatccgaaccgtcaggcaaaaggaacggttattgaagctgagctcgataaaggaagaggatctgtcgcgacacttctcgttcaaacgggaacattgcatgtcggagatccgatcgttgtcggaaatacattcggccgcgtgcgggccatggtcaatgatctcggccgccgcgtgaaaacagccggaccgtccacacctgtagaaatcacgggcttaaacgacgtaccgcaggctggcgatcaattcctcgtctttaaagatgaaaaaacagcccgttctgtcggtgaagcacgcgcttccaagcaactggaagaacagcgcagcgacaaagcgaagctgagcctcgatgatctgtttgaacaaattaaacaaggcgatgtcaaagacatcaatttaatcgtaaaagctgacgttcaaggttcagccgaagcgttaacagccgctcttcaaaaaattgaagtagaaggcgtaaaagtgaaaatcattcacacaggcgtcggtgcgattacggaatcagacattattctcgcatctgcttcaaatgcaatcgttatcgggtttaatgtgcgcccagacggaaatgctaagagcacggctgaagctgaaaatgtagatatccgtcttcaccgtatcatttacaaagtcatcgaagaaattgaagcggcgatgaaaggaatgcttgatcctgagtacgaagaaaaagtcatcggtcaggttgaagtgcgccaaacattcaaagtgtcgaaaatcggcacgattgccggcggatatgtaacagacggccacattacacgtgacagcggactccgcctgatccgtgacggcgtggtcatcttcgaaggggaagtagacgttctgaaacgcttcaaagatgatgtgaaagaagtttcacaaggatatgaatgtggtataacgattaagaaatacaatgacattcgcgaaggcgacgtccttgaagcgtatgtcatgcaggaaatcgaaagaaagtgatcggatttgcggaatgtgaatgcatcatttatgatgcgggatcattaaaggagaaacgagccgttctgaagcggattataacgagggttcagaataagttcaacgtgtcggccgcagaaatcggctatcaggacacttggcagcggaccagcttcggaatcgccgtcgtctcctcctctcacgttcaggcggaaaaggagatccagcgtgtactcgcgtttattgactcctttcccgagatagaacggacgatcactagaacagagtggttttaacttagaggtgattgaattgagtatgagagcaaaccgtgtcggcgagcagatgaaaaaagagctcggggatattatcagccgaaagctgaaagacccgagaatcggatttctcactgtaacagacgtacgtgtttcaggtgatttacaaatagcgaaggtgtatatctccgtcctcggcggagagaaaaagaaagaggaggcgctgaaagggcttgagaaagcgaaaggatttatccgttccgaaatcggcagccgaatcagactccgcaaaacgcctgagcttgaatttgaatttgatgaatcaattgagtacggcaatcgtattgaaacattgattcacgaactgcattcagataaaccgtctgaataacgggaaagaggatgggcgagtgtcgtctgtcctcttttctgcgttttacgggatacaattgataacaaaggagcgaaagacagatggttaacggagttctccttttacataaaccggtcggcatgacttctcacgactgtgtaatgaaaataagaaaactgttaaaaacaaagaaagtcgggcatacgggaacccttgatccggaagtgtcaggcgtactgccgatctgtgtcggacgggctacaaagatcgttgagtacgtcaccgacaagtcaaaaacgtacgatgctgagatcactctcggtttctccacatcgaccgaagaccagacgggagaaacggtcagcgtaaaacctgtcagggagccgctgaaagaagcggatatcaaagccgttttagacgaattgaagggaccgcaggagcaagtgccgccgatgtattccgcggtaaaggtcaacgggaaaaagctctatgaatacgccagagcgggtattgaagtggagcggccgaagcggaatatcacgattgaagatatcgcgctcacttcccctgtcacttataacgaagacacagcatcattccgctttacagtcacgtgctcaaaaggcacttacgtcagaacgttggcggtgacaatcggtgaaaaactcggctatcctgcgcatatgtcgcatctcatccgcactgcttccggcgatttcagccttgatgaatgtttcacgtttgaggaacttgaacagcaggtttcggacggaacggttgcagagcatgccgtgccgatcgatagagcgctcaatcatttgccgaaatgggtcataagtgatacattagctaagaaagctgaaaacgggtcggtgtttgacatcccggcggaattttctgcaatgacagctgacgcccgtatagcggtctgtactgaagacggagaatgtgtggccatttatatgccgcatccttcaaaaaaaggactgctgaaaccggctaaagtgctcatgcaaaaaagcgaacaataagaaaaaaggtgaccgttctgtgaagacgatacatatttctcatccgcatcatttacaaaaagaagagcagccggcgtctgtcatggcgctcggctactttgacggcgttcatttgggacaccggaaagtaatcggaacagccagacaaattgccgaagaaaaaggcctgtcgctggccgttatgacgtttcatccacacccttcccatgtgttgggcagggacaaagagccaaaggatctgattacgccgcttgaagataaaatcagccagatcgggcgtttaggcgctgatgtgctgtatgtcgtaaagtttgatgaagcgtttgcgtctctgtctccaaaacagtttgccgaggagtatattttagggttgaacgcgcggcacgctgtgggaggcttcgattttacgtacggaaaatacggaaaaggtacgatggagacgttgccggacgatttaaacggcaaggccggatgcacgactgtcgagaaacagaccgagcaggacagaaagatcagctccacttatatccggtcagcgctccaggatggtgacgttgaacttgcgcacactcttctcggccagccgtattttatccggggcactgtgattcacggagacaaaagaggccgcaccatcggttttccgaccgcgaatgtcggcctgcacaacagctatatcgtgccgccgacaggcgtgtatgcagtgaaagccgaaataaaaggcgaggtgtatgaaggcgtctgcaacatcggctacaaaccgaccttttatgaaaagcgtcccgatcagccgtcaattgaagttcatttgtttaattttcaacaggatgtatacggagaagacgttaaaatcgagtggtacaaacgaatccgaagcgaacggaagtttaacggcatcgatgaactgacggctcagatcgggaaagacaaacaagaagcgatccgttttttcagcaaataacggaaaaaacatcaaaagtacacaaattttattctaaaagatttgcatatgggcgcgatttttagtatcatatgtttcgtagtcttaaaaccattgcttggcaatccgaagtcaccgacggttgctaggtaactggggctaattatgatatggaggtgaaacaggatggcaattactcaagagcgtaaaaatcaactcatcagcgagttcaaaacacacgaatctgatactggttctccagaagttcagatcgctatcctaacagactcaattaacaacttgaacgagcatttgcgtactcacaagaaagatcaccactcacgtcgcggtcttcttaaaatggtaggtaaacgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaaaaaataataataaaaaaacaatgaaatccttttacatactactttgacattgatatgttcaattcatttcgttcataataggagtaattgattatttcacacattaagagaggagctcgtaatcgaatgggacaagagaaacatgtctttaccatagattgggccggcagacagcttacagtagaagccggccagcttgccaaacaggcaaacggcgctgtcatggtccgctacggcgatactgcagtgctcagcacagcaaccgcatcaaaagaaccgaaaccgctagattttttcccgcttaccgttaactatgaagaaagattatacgcagtaggtaaaattccgggcggttttattaaaagagaaggccgtccaagtgaaaaggccgttttagccagccgtctgatcgaccgtccgatccgcccgcttttcgcagacggattccgtaacgaagtacaggtcatcagcattgtcatgagtgttgatcaggactgctcatctgaaatggctgcaatgttcggttcatcactcgctctttgcgtttccgatatcccgtttgaaggcccgatcgcgggtgtgacggtaggccgcattgaggggaaattcgtcatcaatccgacggttgaccagcttgaaaaaagtgatatcaacctcatcgttgcaggcacaaaagatgccatcaacatggtggaagccggagcggatgaagttcctgaagaaatcatgcttgaggcgataatgttcggtcacgaagaaattaagcgcctgatcgcattccaagaagaaatcgtcgcagcagtcggcaaagagaaaacagagatcgaactgtatgaaattgacgaagagctcagcgcaaaagtaaaaagccttgcggagccggatctgcttagcgccattcaggttcacgaaaaacatgctcgcgaagacgcgatcaatgaagtgaaaaatgcagttgtcgcgaaattcgaagaagaagagcatgatgaagatacgattaaaaaagtgaaacagacactgtctaaactcgtgaaaaacgaagtgcgccgtttgatcacagaagaaaaagtccgtccggacggccgcggcgttgatcaaatccgcccgctttcttcagaagtcggccttctgccgagaacacacggatccgggctgtttacgagaggacagacgcaggcgctcagcgtatgtacattaggagcccttggagacgttcagattcttgacggtttaggcgtggaagagtcaaaacgctttatgcatcattataacttcccgcagttcagcgtaggggagacaggcccgatgcgcggaccgggacgccgtgagatcggtcacggtgctcttggagagcgtgcgcttgagccggtcattccgaatgaaaaagacttcccgtatacggtccgcctcgtatctgaagtgcttgaatcaaacggttccacttcacaggccagcatctgcgcaagtacgcttgccatgatggacgcaggtgttccgattaaagcccctgttgcaggtatcgcgatgggacttgtgaaatcaggcgagtactatacggtattaaccgatattcaaggaatggaagacgccctcggtgacatggactttaaagtagccggcacggaaaaaggcgtgacagcgctgcaaatggacattaaaattgaaggcctttcaagagaaattcttgaagaagcgcttcagcaggcgaaaaaaggaagaatggaaatcttggacagcatgctcagcacgcttggtgaatcaagaaaagaactttctcaatatgcgccgaaaattttaacgatgaccattaatccggataaaatccgtgacgttatcggaccgagcggtaaacaaatcaacaaaatcattgaagataccggtgttaaaattgacattgaacaagacggcaccatctttatttcttctactgatgaaagcagcaaccaaaaagcgaaaaaaatcatcgaagatcttgtcagagaagtcgaagtcggccaactttacctcggtaaagtgaaacggattgagaaattcggcgcttttgttgaaatcttcagcggaaaagacggtctcgttcacatctctgaactagcgctcgaacgggtcggcaaggttgaggatgttgtgaaaatcggtgacgaaatccttgtgaaggtaactgaaattgacaaacagggacgagtgaatctgtcgcgtaaagcagtgctgcgcgaagagaaagaaaaagaacaggaacaacaacaatcttaaatgaaaacctaacaaggagcctgggagacccggcttctttattttgagaaagacaacagacgggttctaccttgtcctcctcatacataatgtgtgatgaggggggaaggacatgttgaaaaaattcgtgccgtttgccgtttttttatttcttttttttgtttcgtttgaaatgttaaaaaacccgtatacagttgattacatagacgcaatgaaaaaagacgcggtaactgtgtcagcatcaaaagatccgctctatgaagaattactgcaaaaagcgtcagagtatgaagtgaagccgcaagacgcgcggattgataaaatatggaagagtataccggggtataacggtttaaaagtcaatgtggaaaaatcctataaacaaatgaaaaaggacggagaatttcacgaagacgaccttgtctatgagcaggtaaagccgaaagtccatcttgattctctcgcgcctgaacccatttataaaggaaatcccgacaaaccgatggtcgctttcctgataaatgtcgcctggggaaatgaatacgtggagcaaatgctgcctattctgaagcagcaccaggtcaaagcaactttctttcttgaagggaaatggctgaaaaacaatcaggaactggggaaaaaaatagcggcagacggacatgaaatcggaaatcattcatacaatcaccctgatatgagcaaactgacttcaggaagcatttccgaacagcttgacaaaaccaatgcacaaatcagcgagacgctcggcatgaagccgaaatggtttgcgccgccaagcggcagcttcagaaaagccgtggtcgaccttgcggcggaaaaaggaatgggcaccatcatgtggaccgttgacaccattgactggcaaaaaccgtctcccgctgttttacaaacaagggtgttgagcaaaatacataacggagccatgattttaatgcatccgactgatccgactgcgaaaagcctggatacactgattgcaaaaatcaaagaaaaaggctacgcgctcggctcagtgtctgacttaatggatgaaaacaggctgatgaagtagcaggcggcagttgcctgtctttgaataggaggaacagacttgataaaacgctatacatgccaaaacggtgtaagagttgtgcttgaaaataatccaacggtgcggtctgtggcaatcggcgtctggatcgggacgggatcacgtcatgaaacgccggagacaaacggtatttcgcactttcttgagcatatgttttttaaaggaacaaataccaggtccgcacgtgaaatcgcagaatccttcgatcggataggcggccaagtgaatgccttcacttcaaaagaatatacgtgctattacgccaaagtgctggatgagcatgcaaactacgcacttgatgtgctggctgatatgttctttcattctgcttttgacgaagatgagctcaaaaaagaaaagaacgtcgtatatgaagaaatcaaaatgtatgaagacgcgccggatgacattgtccacgatctgctgagcaaagcgacatacggcaatcattcgctcggatacccgattctcgggacggaggaaacgctttcgtcgtttaacggcgattctctcagacagcatatggatgacttttacacgccggaccgcgtcgtcatttctgtcgccggaaatgtaacggaacaattcattaaagacgtggagaaatggttcggtacatacgaagcgaagggcaaagcaagcggcatcagcgagcctgagtttcattatgaaaagctgaccagaaaaaaagacaccgaacaggcgcatctctgtctcggtttcaaaggcctgaaagtcggagatccggacatttacgatttgatcgtcttaaacaacgtgcttggcggaagcatgagcagccgtcttttccaggatgtgcgcgaagataaaggactggcctattctgtatacagctatcacagttcctatgaagacagcggtatgctgacgatttacggaggcaccggcgcgaatcagctcggacttctgtctgaaaccattcaggaaacgttatcggttctaaaacgtgacggtatcaccccgaaagagctggaaaacagcaaagagcaaatgaaggggagcttaatgctcagcttagaaagcacaaacagcaaaatgagccggaacgggaaaaacgaactcctgctcggaaagcataagaccatggatgaaattatcgctgaattaaatgcggtcagcctggaaagcgtcaacggcctcagccgccgcttatttacggatgattacgcactatcgctcatcagcccgaccggcaatataccggcctcgtcttaagctgcaaagcagtctgcctctatacggggcaggcatttttttttgctccgggtcatatagtacaagggggtggctatcatgaggctcagtgaactgtcaggtaaagaaattgtggacattaaacgggcagagcggctcggcgtgctcggccagaccgatttggaaattaatgaacaggacggacaaattaccgcgctgttgataccgacggtaaaatggttcggattgcgaaaacaaggccacgacatccgcgtcccctggaaccatatccaaaaaatcgggtcagacatgatcattttagacgttccgggggagatcacgcctcccgaagagtagatcttattcattttttgcaagcaccggctcatacagccggtgcttttttcatgaaaaagacgctgtacattcaccgccctttctctttgcacatacgatgaagaggaggatgacacttaaaagatccagtaactgtaaagaaggtgaacgtttcagatgttaaccggattaacaattgcgatcattggcggtgacgcaagacagcttgagattataagaaagctgacagaacagcatgccgatatttatcttgcagggtttgaccaattggatgacggttttacaggaaccgtcaaatgcaaaattgatgagattccctttcaaaaaatagacagtatcatcctgcctgtatcggcaacgaccggagaaggcgttgtttccacggttttttcaaatgaagaagtggtattaaagcagagctatcttgagcggacaccggagcattgcgtcatttattcaggcatctccaatgcatatcttgaggggatcgccagcgaagccggccgtaagcttgtgaaattatttgagcgggacgacatcgcgatattcaactcgattcccactgttgaaggaacaatcatgatggcgattcagcatacggattataccattcacggatcaaatgttgccgttctcggcatggggcgcaccggtatgacgatcgcccggacgtttgcagcgttaggggcgaaagtaaaagtgggcgcgcggagttcggctcatttagcccgtatatcggaaatggggctttctccttttcaacttgaagaacttactgaacatgtaaatgatattgatatctgcattaacaccgtaccgagcttgattctgaatcaaagcgttttatcgcgcatgacgccgaagaccttgattttggatttagcatcccgtccgggcggaacggatttcaaatatgctgaaaaacaaggcattaaagcgctgcttgctccgggtcttccgggaattgtggccccgaaaacagccggacagattattgcgaacgtattgagcaagcttttggcagacttaaagaaagaggggaaatagccatgtctctgaaagggaaaagaatcggattcggattaaccggctcgcattgcacatatgaggaagtttttccgcaaatagaggcgcttatcagtcaaggagctgaagtccggccggtcgtgacgtcaaccgttcaatcgaccgatacccgctttggggaggggggagattgggtcagaaaaattgaagaagcaacaggctttgaggcgattgattccatcgtaaaagcggagcctctcgggccgaaacttccgctcgactgcatggtcatcgcccctttaaccggaaattcaatgagcaaactcgcaaatgcgatgactgacagccccgtccttatggctgcgaaagccacgatccgcaacggccggccggtcgtgctcggaatttcaacaaatgacggactcggtttaaacggaacgaatttaatgaggctgatgtccgcaaaaaacatatatttcatcccgttcggccaggatgaccacgtgaaaaaaccgacatcgctcgtcgccagaatggatctccttccgattacggtagaaaaagctcttttgcaccagcaggttcagccggtgctcgtacaccatcatgaataaaaaatcatgatgacagaaaatcattccggaataaaaaaattcggtcaatccgtgactattctatggtaaaataaaacgtaaaatgcaaagtcaattcaacaaatgatgcttaattggcggaaggagttttacagatgggaagaggattacacgtagcagttgtcggagcgacgggagccgtaggacagcaaatgctgaaaacactggaagacagaaactttgaaatcgaaacactcacactactatcctcaaagcgttctgctggtacgaaagtaacgtttaaaggcgaaggatatacagtgcaggaagctgttcctgaaagcttcgaaggcgttcatatcgcgttattcagcgccggcggaagcgtatcacaaagcttggcgcctgaggctgtaaaacggggagccatcgtgattgacaatacgagcgcattccgtatggacgaaaatacaccgctcgtggtgcctgaggtgaacgaaggtgatctgcacaaacataacggcattatcgccaaccctaactgttcaacgattcagatggtggctgcgcttgaaccgatccgcaaagcgtacggtttgaaaaaagtcattgtatctacttaccaagctgtttccggagccggcaatgaagcggcgaaagaattgtacagccagacaaaggcgattttaaacaatgaacccgcagaaccgtccattatgccggttaaaggcgataaaaagcattatcaaatcgcatttaacgccattccgcaaattgataaattccaagacaacggctatacgtttgaggaaatgaaaatgattaatgaaacgaaaaaaatcatgcatatgccgaagctggaagtggctgcgacatgtgtcagactgccgattgaaacagggcactcagaatctgtttacattgagcttgaccgtgatgacgcaaccgttgaagatattaaacagcttttaaaagaagctccgggtgttacgcttcaggatgatccggcggagcagctttacccgatgcctgctgattgcgtcggcaaacgcgatgtatttgtaggaagaatccggaaagatttggacagagcaaacggttttcatttgtgggttgtttctgataacctgttaaaaggcgccgcttggaactcagttcaaatcgcggaaagcctgcaaaaactgaacctcgtataaaacaaacgtattttctataggcgaacagaagagagtaaggctctgcctgctctcttctgttacgtcagactaatttggagtgaaaatagtgaagatcatagttcaaaaattcggcggaacatccgtaaaagatgacaaaggccgcaagcttgcgctagcacacattaaagatgccataagtgaaggttataaggttgtcgttgtcgtatcggcgatgggaagaaaaggagacccgtacgcgacagattctttaatcgggctcctttacggcagccagtccgacatttctccgagagagcaggatatgcttctgtcttgcggagaaacgatttcgtccgttgttttttccagcatgctgaaggaaaacggcataaaagccgcagctttaacaggagcccaggccggctttttaaccaatgcccagcatactgacgccaaaattatagaaatgaaaacagagcggcttttcgctgcactcgccagccatgatgccgtcgttgtcgcagggtttcagggagcgactgaaaaaggcgacacgacgacgatcggcagaggaggaagcgatacatcagcggcagcgctcggcgcggcggttgatgctgagtttatcgacatttttacggacgtggaaggtgttatgacagccgatccgagaatcgtggaaaatgctaagccgcttccgaatgtcacatatacggaaatctgcaaccttgcctatcaaggcgcgaaagtcattcatccgcgcgcggtggaaatcgccatgcaggcaaaggtgccgatccgcgtgcgctccacttattcaaaagacaaaggcactttggtgacgtcccatcattcgtccaacgtcggcagcgatgtattcgaacggctgatcacggggatcgcccatgtgaaagatgtgacgcaatttaaggttcccgccaaaatggggcaatacaacgttcagactgaagtctttaaagcaatggcaaatgccggaatcagcgtagatttctttaacattacgccgagtgaaatcgtatataccgtagccggcagtaaaacggaagccgcgcgcagcatcttggctgaattaggatatgagccgacagtgacggaaagctgtgcgaaagtgtcagcggtcggcgccggaataatgggtgttccgggtgtcacgtcaaaaatcgtctccgcactttctgataaaggcattccgattctgcaatctgccgacagccatacgacgatctgggtgctcgttcatgaaaaagatatggtaacggccgtaaatgcgctgcatgaagtgtttgaactttcaaagtaaatgtgattgaatcatgatgaggtgaaaaaaatgaatgtcggaaatatatctacagcgatgattaccccctttgacagtaaagggaatgtagactttcaaaaactgtctacattaatcgactatttgttgaaaaacggcacggattctttagtcgtcgcaggcacgaccggcgaatccccgacactttcaacggaagaaaaaattgcactctttgaatttacagtcaaagaagtgaacggacgcgtgcctgttattgcgggtacaggaagcaacaatacgaaagactccattaaactgacaaaaaaagctgaagaagccggcgtcgattgcgttatgcttgtcacgccgtattataataagccttcccaagaggggatgtaccgtcattttaaagccatagctgaagaaacgtctctccctgtgatgctttacaacgtgccgggcagaacggtcgcttcgcttgcgccggaaacggccatcagacttgcggagattccgaatatctctgcgattaaagaagcgagcggcgatcttgatgccattacgaaaattattgccgaaacaccggaagatttttacgtctattcaggtgatgacgggttaacgcttcctattctcgcagtcggcggaagaggagtcgtgtcagtggccagccatatcgtgggttctgacatgcagcagatgattaaaaactatacgaacgggcagacggcaaccgcggcactgattcatcagaagcttctgccgatcatgaaggagctctttaaagcgcctaatccggctccggtcaaaacggcgctgcagctgaaaggccttgatgtcggatctgtgcgtcttcctcttatcccgctgaatgaagatgaacgtctgagcctgagcagcgtcatcagcgaactgtaagaaaaaatttatacagttgaaatacgcggtcattctcatttttatcgtgagtttgaccgttttgtatacatattggttttccctaaaccttccgcttcttcttgttttctaaaattgatatcagttataataggaacaagtgatgatggacgggtatgagactaggaggatacagattttgaaaaagaaaaatacagaaaacgtcagaattatcgcccttggcggcgtcggagaaattgggaagaacctatatgtcattgaaattgactcagacatatttgtagtggatgcagggctgatgcaccctgaaaatgaaatgctcggtattgatgtcgtcattccggatatttcctacttagtagaacgggctgaccgcgtgaaggccatctttctgacacacgggcacgatgaaaacatcgggggcgtcttttatttattgaacaagctgttggtgccggtatacggaacgaagcttacgcttgcattactgagagaaaaactcaagcagtacgggcataatcgaaaagctgatttacgtgaagttcactctaaatcagtcattacatttgaatcaacgaaagtatcgttctttaaaacgattcacagcattccggattcagtcggagtcagcttcaaaacatcacttggctctattgtatgcacgggagacttcaaatttgaccagacgcctgcttatcatcaatcatgtgatattggcgaaattgccaaaatcggaaacagcggcgtgctcgccctgctttctgacagcgccaatgcggagcgcccggggtatactccgtcagaagcatatgtaagcggtgaaatttccgatgcgatgaacaattcagaaaaccgtgtcatcattgctgtattcgcgtctaatatcaaccggatccagcaagtgatacaggctgccgtccagaacggccgcaaacttgcaatcgccggaaaaaatctgcaaaacgtgcttcagcttggacgcaagctcggctatattgaagccgaagatgaaatgtttattcctgtgcaggatgtgaaaaaatatccgaagcgggacgtggcaattgttacagccggaagtcatggagagccgctggccgctcttacgcgaatggccaagcaggcgcacaagcagcttaacattgaagaaggagacaccgttgtcattgcatcaacaccgattccggggcatgaattgatatattccaaaaccgtcaacctgcttgcccgcgccggcgctcaagtgattttcgcccaaaaacgagtgcatgtgtccggtcacggttcgcaggaagaattgaaactcatgcttaatttgctgaaaccgaaatatttaattccggttaacggtgaattcagaatgcaaaaagcgcattccaaaatcgcagaagagatcggcatgaaacgcagcgatattttcttgattgaaaaaggtgacgtcgttgaattccgcggccagaatgtgaaaatcggggataaagtcacatacggaaacgttctgattgacggcctcggagtcggcgacatcggcaacatcgtgctgagagaccgccgcttattgtcacaagacggcattctcatcgtcgtgatttcactcgataagcagaagaagaaccttgtttcaggccctgagatcattacgcgcggttttgtgtatgtcagagaatcagaggggttaattgtacaagctactgagctcgtccgctctatcgtgactgaagcgacagaaacatctgccgtagaatggtccacgctgaaacaagcaatgcgtgatgcgctgaatcaattcctttatgaaaaaacaaaacgcaagccgatgatcattccgatcattatggaagtataatgtatacaaagccggagcgcatcatgctccggctttgtttttgttcatgtcccggatggaaatcatcatctttgttcataatacaaagagacattcggaaagggtgaaagataaaatggatcatcgtatggaaaacaccgaggaacagcagcccgaaaaatcagatgcgaaagacagcattatgagcaaaattcagcagctgggagagacatctctgccgcaaatgtcccaagataccaatattcactgcctgacgatcatcggccaaattgaggggcacgtccagctcccgccgcaaaataaaacaaccaaatatgaacatgtcattccgcaaatcgtcgccattgagcaaaatccgaaaatcgaaggacttctgatcatcttaaacaccgtcggaggcgatgtggaagcggggcttgcgattgcggaaatgctcgcatccttatcaaaaccgaccgtctcaatcgtactcggcgggggccactccataggtgtgccgatcgccgtgtcatgtgatcatagttttatcgcggagacagcgacaatgaccattcaccccgttcggcttacaggtctggttatcggcgttccgcaaacgtttgaatacctggataaaatgcaggagcgggtcgtcaactttgtgacccatcattcaaatatttccgaagaaaaattcaaagagctgatgttttcaaaaggaaacttaaccagggacatcggaacgaacgtagtcggcaaagatgcggctgattacggactaattgatgacgtgggcggcgtcggacaggcgataaaaaagctgaatcagctgattgaggaacgaaagggcgaggaaggaaggatgattcaatgatcctttataccgtcatgccccaagaagtcgtttacggtcaggatatagagaaaagcgtgcatgaacaggtagattacgccggtgtgccgctgctggttgagatgaagggaaatgaagctgaagtcgtacagattttaagtacgaacccgatggattttctgaatccggacatcgctccgggacaaaaaatcaagctgaaaatctaaccggcattcagtccgtttctcgggggcaaaatatgctataataggggaatcctacagaaaaatgcagccggcaaaaggctgcttttcttcatgatgtatgattttacattttttaacgcagtaaggtgatgagtgtggcaaagaaaaaacggaaatctaaaaagaaacaagagagtaagctcaatctaaaatacgaactaagcggactgctctgtgttgcaatctcgattattgctgttttgcagctcggcgttgtgggacagacatttgtgtacttgttccgtttttttgccggagagtggtttattttatgcttaattgcgctcttccttctcggaatttcgctgttttggaaaaagaagagtccaagccttttaacgagaagaaaggcggggttgtactgtattatcgccagtattttgctgctgtctcacgtgcagctctttaaaaatctgtctcatcacgggtcgattcggtcggcaagtgtcatcggcaacacgtgggagctgtttatgattgacatgaaacagcaggctgcttcccctgatttgggcggcggcatgatcggcgcggtactgtttgcagcttcccactttttatttgcatcaacgggttcacaaatcatggcgatcgtgctgatcttaatggggctgattcttgtaacggggcgttcactgcaggaaacgctcaaaaagtggacgagccccgtcggcaggtttatccgcaatcaatggcaggcatttcttgaggatatgaagacggtcagaacgaatatgtcttcgccgaaaacaaaaaccaaatcgggcaaaaaacaaaaacgggttcaaaagaaaaaagaaatgcctgagcccgaagaagaggatgaggaaatcatttcgccgatcatccattcagagccgattatttcaagcttttcagaccgtcaggaagaacgcgtcgaaccgctgattccggaaaaaacgcaggagacggcgcaagcggcaaaagatgagccttccggcggcgctcaagacagtgacgaaacggctgccgctccgccgatgacgtttacggagcttgaaaataaagattatcaaatgccttcattggacatactggctgacccgaaacataccggccagcaaaccgataagaaaaacatttacgagaatgcaagaaaactcgaacggacttttcaaagcttcggggtaaaggcgaaagtgacccaagttcatctcggcccggcggtcacaaaatatgaggtgtatccggacgtcggggtcaaagtcagtaaaatcgtgaatctgagcgatgaccttgcgctcgcgcttgccgccaaggatatccggatagaagcgccgattccgggtaaatcagcaatcggcatcgaggtgcccaatgctgaagttgcgatggtttcgttaaaagaagtgcttgaatccaagctcaatgacaagccggacgcgaagcttctgatcggcttgggacgaaatatttccggggaagccgtgcttgccgaactgaacaaaatgccccacctgctcgtagcgggggcaacgggaagcggaaaaagcgtctgtgtcaacggtattattacgagcattctgatgagggccaaaccgcatgaagtgaagatgatgatgattgacccgaaaatggttgagctgaatgtgtataacggcattcctcatctgcttgcgccggtcgtgacagatccgaaaaaggcctcgcaggctttgaaaaaggtcgtcaatgagatggagcgccgctatgagctgttctcccatacgggtacgagaaatatagaaggctataacgaccatataaagcggtcaaatgccgaagaagaagtcaagcagcctgagctgccatacatcgtcgtcatcgttgacgagcttgccgatctgatgatggtcgcttcttccgatgtggaagattcaattacgagactttcacagatggcgcgggcggcgggaattcatttgattatcgcgactcagcggccttcagttgacgttattaccggtgttattaaagccaacattccgtcaagaattgccttcagtgtttcatctcagaccgattcacggacaattttagacatgggcggcgctgaaaagcttctggggcgcggagacatgctgtttctgcctgtaggcgcgaataagcctgtccgggtccagggagcatttttatcggatgaagaggttgagcatgtcgtcgatcatgtgattacgcagcaaaaagcgcagtatcaagaagagatgattccggaagaagtgtcggaaacacacagtgaagtaacggatgatctctatgacgaagcggtcgatttgattatcggcatgcagacggcatcagtctccatgcttcaaaggcggttcagaatcggatatacgagagcagcccgtctgattgacgcaatggaggaacggggcgtcgtcgggccgtatgaaggaagcaaaccgagggaagtactattatctaaggaacaatatgatgagctctcttcttaaaaaggagagagttttcactgaaaatgatatcaccaaaatcattcctatttatttttttattaaaacatgatatagttgtcccaattgttcaataatttatgaaagtggtttacggaggggaaacatgtctacaaaagctgacaatcgtcacttgtacctaaaagtgattgagcgaatcaaagaggatatacaaaacggaatttacaccgaaaaggaaaagcttccttctgaatttgagctttcaaaatctatgggtgtcagccgggcaactctgcgtgaagctttgcgtatccttgaagaggagcatgtgattatcagaaggcacggtgtgggcactttcgtccatacaaaaccgctgtttctttcaggtattgaacagctcaacagcgtgacgaaaatgattcagcaggcgaacatggtgccgggtacgatttttttgtcgtctcaggtcatcacgccgtctgatgaagatatcgctagattccggcttgagcctgagcaggagcttttttatttggaacgcgtgagaacggcaagcggcactccggtcgtttactgtttagattcgattccgatgcacattctgccgaattctttctgtcatgaacaggaatctatttttgatcttttggaaaaaaactccgggtctgtgatcagctatgccgttgctgatatcgaaccgatcggatatcacgatacgatttcaccggttttggaatgcgagccggagacggcgcttttattgctgaagcaaacccactataatcagaatgatgaacctgtgctgtattcattaaattatttccgggcagataagttcagttttcatgttgtaagaaaacgtttttaagacagacgcgtcatgtgtctgttttttttatttgccgcttcaatacatactttgttttccgcaaggcacaataaaacaggaaacaaccaagtatagtgaatgggtgaataagttgagtaagaagaaaaatggaacaaaaaatatcattgctctggcttctgtaccgctcgtgatgacactcgggaattccatgctgattcctgtgcttccgatgattgaaaagaagctgtccatatcgtcttttcaagtatcgttaattataacggtctattcgattgtggctattatttgtattccgattgccggatatttgtccgataaattcggaagaaaaaaggttcttctgccttgtcttctcatagccggtgcgggcggagcgcttgccgcgatagcttccaccgcgttcaagcatccttatcccattatcttggcggggcgggtgctgcagggaatcggttcggcaggggcggctcctgtagtgatgccgtttatcggtgatttattcaaaggggatgatgagcggattaccgcggggctcggcgacattgagacgtcaaacacggccggaaaagtattaagcccgattctcggatcgctcttggctgcatggttttggtttatgccgttttggttcattccgtttttttcgctcatcagtttttttctcgtattgtttttggtggcaaagccggagaaacaaaaagaagcgccttctatttccgaatttgtgaaaaatgtcggccgcatatttaagcgtgacggacgctggctctttacggtatttatcatcggctgcgtgattatgtttttgctgttcggggttcttttttatttatcagactcactggagaagaaatacggaattgacggtgtggctaaaggagcgcttttggcaatcccgcttttatttctatccgtcagttcatatatatcaggcagaaaaatcgggaaagaccaaggcaaaatgaagttttgcattgttttcggaatgagtgccgtgacactgtcgtttatcggcctatggtggaatcacagtttttatttattatttatctttttgtgtgtcagcggtatcggtatcggaatagcattaccggcattagacgctgtcatcacagaaggcgtagacaacgaggaatcgggaaccatcacctcattttataacagcatgcggtttatcggagtagcggcgggaccgccgatctttgctgccctgatgtcaaatgcaggctggctgatttttattttatccgctttttgcggcattgtgtctgtatttttagcgctgttaaatatctcatcacaagctaaagaaaaaaaggaatcattaaagacggtgtaatctgcactgtctttttttattttgaagattgacatgatatcgtcaagtcgttatcctttttaatagttaaacattttaactattggaaggagggggaaaaggtgcatgaagaaaaagtaaagcagctgattcagcgttattccgatgtatacctgcacgtcttaaaaaaaattgacagcattatcgctgaaaaagtgaacaaagagctgacattggatcaatattacatactccgctatattatgctcaatccggattgcaaatcaattgaactggccgcggtgtgccacgtcaataaaagcgccattacatcgatgacgaaccgcctgtatgaaaaaggctacatcaatagagaacgcagcgaaagcgaccgccggagcatacttttaaatgtcacggaaaaggggacggaagtatttcaccgtgtggagcggcggattgaggaactcgtccgttcatatattatgtattttgatgaagacgaggcggagatgttcgttaatacatatgaaaaattatatcgattgatgatgacagaggaggatcagcagacataatgaaaaacattatccgagcccgctggatcatcgccgcgttatggatcgccgcaacggtgatatttatgcttacagcgcctgatatggctgaattgacacgggagaaagggcagatttccgtaccggacggatattcctcttcttatgcccatgaattgcttgatgaaatgtctgattcagatgcaccgtcttcttctgccgtcatcgtatttcacgaaaaaggcttaatgacagacaaaaaagatcgtctggaagaagccgtcagcactttgtctgaacagaaaaaagcgcttcagattaaaacggtgacttcatacttcggggagaaaaatgacgacatcaaaaaacagctgctgtcaaaagacagacaaacgatgctcgttcagctgcagcttgatacatccaaaaacgatatcctcgaaataaaaaataaaattgataaagagctgaaaccgtacggcgtatcatacggcattacaggccagtcgctgatcgacgaagatgtgttaaaaagctcacaggacggcttgaaaaagactgaatatataacggtcgcttttatcctgatcgtgctggtccttgtattccggtcagtggtcgctccgtttgtgccgcttttatctgtattgatatcttatttagtcagccagtcgattgtcgcatttttagtcggccagctgaattttccgctctcaacttttacgcagatttttatggttgcgattatgttcggaatcggcacagactactgcattctgcttctcagcagatttaaagaagaactgtcgcatggcgctgatataagagaagcgatcgtcgtcacctacaaaacggccggaaagacggttttgtacagcggcggtgcggtgctgatcggatttgcctgcatcggatttgcgacatttaagctgtatcagtcggcagccgccgttgcggtcggtgtcgcggtgctgctgcttgcgctcatgacgatcgtgccgttttttatggctgttttaggaaaaagactgttttggcctgttaagggcgatatttcccatcctcaaagcaaagcatgggaaacggcagggcggttttcatttaaaaggccgctcatcagtcttgcaatcgttgcggtattcaccgtcccgcctatccttctttacaaaggatcgctatcttacaacagccttgacgaaatcggggacaaatatgaatccgtccgcgcgtttaatacgatttcaggcgcattcggcccgggagaacttcttccggccacagtcgtcatcaaaaatgatgagccattaaataccgaaaaacacctgattgatatcgaaaaaatcagcagagaacttgaaaaaacagagggtgtaaaaacggtcagaagcgccacgcgccctgccggaaacggattgaatcaattatttgtcacaaatcaggcaaagcagcttcaagaagggcttgataaaggcaatacaggacttgaaaaaatcacggacggattagggcatgccgcaaagtcgttagccgattcacagccgcagatcgaagagtcggggaaaagcgtcaatcagcttattaacggaacattgtctctgaaatccgggctttctgatataggagaaaacctgaataaactgcaggctggcgtgaatgagaataaagccggcgtcgcccagatgagaaatcagattgaagagcaaaaacaaatgctgacttcacagctcaaacaaaacagcggtctcgcttcagaaacgcaaaacgctttaaaattggtaaaaaccgtcctgccgatgaaagatgaagccagcagacagcttgccgatttgaacaagcagcttgcccggctgccgtttgcaaaattggaagcgtcaataccgtcagtcaaaaccgatccctcttacaaagaaatcaaatcggcctttacgggtgtacagtcagccgtttccaaggcaaacgcggatgcagaagcgttttctaaacaggtcgacagtcaaaaggatcatctgcagcaagcggaaaaacaatttgcccggctggcagccgcacagaagaagattgacactcaaattaacgcaatgatcaatggactgaccagtattgaaaacggtctgcagcaagtgtcagacggacagggggctcttgcaggacaaatgccgcgccttgaatcggcggcaggacagctcgcggagggccagaaaaaaatgaagagcggtctcggtgatttttcttcccggctcagcgatctttcttcaggccttaacgatagtgtaaaagggcttaagaaagtatcaagcggcatgatgggggcgaatgattacctgggtgagcttcacaaggcgtcagataaagaaatgacaggctggtttgtgccgagagacgcgttgacaaacagtgatttcacaagcgtgtttaatacgtacatgtcagatgacagaaaaacgacagaattgaccgtcgttcttgataacaatccttactcaaatacggccattcaagatattcaagcgatcaaagcgagcgtaaaaagagccattccgaacacggatctgaagaatgcctctttcggcgtttcgggagtctccagcatgaatgccgatctgaaagaagtatcggattcagacttcaaacggacggcaatgtttatgctggcgggaatttttctgattctcatcataatgctgcgctctctcattatgcctgtttatttagtggcgtcgctcgtactgacgtatttcgcatccatcggcgtgacggaatacatctttacacacttcttcgggtatccgggcgtaaactgggccgtaccgttcttcggctttgttattttgatggctcttggtgtggattattccatctttttaatggaccgctttaatgagctgaaaaaagaaggaacggggcccgcaatgatcagcagtatgaaaaatatgggttccgtcatcatttctgcggcgattattttagcgggaacctttgcggccatgctgccgtcaggcgttctttccttattacagattgcaaccgtggtattaacaggccttctcatgtacgcaattgtcgtccttccgttttttgtaccggtcatggtgaaaatattcggaagagccaactggtggcctttcaatttgaaaaaataacgtacaatgcctctgcctgttttcgggcagaggttttttgtttccttataaatcctccagttgatataattacatctgcgcactcttttttgcgaatgctgaaatttggtcataatacatactattaaagaatgaacgaaggaggtttcacatgacttatgtaaatgaaatgaagtcaaagcacggcgggatcaccgcccatatcgtaaagactgagaaatttaaaaccgtttcgctgacgtttaaaatgctggctcctttaacgaaagagctcgtaacaaaaagggcgctgtttccgcatgtgcttctgcgcggaacagaaagccgcccgaaaaccgctgatctgcgttcttattttgatgagctgtacggcacatccgtttcagctgatctgacaaaaaagggagaacgtcatgtcattacgttcagacttgagattcctaatgaaaagtatctgaaggaccgcacaccgctattggaaaaaggccttcagcttttatcagagcttgtcttttcgcccgctttggaaaacggcgccttcctgcccctttatgtcacgcaggaaaaacggacgctgaaacagcggattcaagccgtatatgatgataagatgagatattctaatctgcgtctcgttcaggaaatgtgcaaaagcgaaccgtatgcccttcacgtcaacggcgagttcgatgatgttgaacacattacaccgcaagatttgtatgaagcctatcaaaaagccatacgcgaagatcagctggacctgtacgtcatcggcgatgttgattcagatcaggtgaaaacggccgttgatacgtattttaaaacggaagaacgggagctgcagccttttgaaagaagcgcggcgaatgaacagcccgatccgaaggaagtcattgatgaagaggacgtcaagcagggcaagctgaatatcggattccggaccaatacgacatatacagatccggattatccggcattgcaggtgtttaacgggctgttcggggggttctctcattcaaagctgtttataaatgtccgtgaaaaagcgagcctcgcctattatgcagcctcaagggtggaaagcttcaaagggcttttgatggtcatgtcgggcattgaggtgaaaaattataagcaggccgtcaccataatcgaagaacaatttcaggctatgcaaaacggtgacttttcagaggacgatatcgcccaaacgaaagccgttattaaaaaccaagtgttagaaacgattgatacggcatacggcttatcggaatttctgtatcagcaggcttcagcccaagtggaaataccgatcgaaactttcctcgacaatatcgagaaagtgacaaaagaggacattatcaatgtcggaaagaacattaagctggatacgacttatttcttaaaagggacggggggagcatcttgactaaaccgataaacttcgaacagcttcaggaaacgctgtatcatgaaaaaatggcaaacggccttgatgtctatgtgctgccgaaacagggttttaataaaacatacgccgtgtttacgacaaagtacggttccattgacaatcaattcgttcctttaaataaggaagaaatggtacacgtccctgacggaatcgcgcattttctggagcataaactgtttgaaaaagcggacggcgacgtgtttcaggacttcagtaagcagggggcgtcggcaaatgcctttacatcatttacacgaaccgcttatctgttctccagcacttctaatgtagagaaaaacctggaaacactcgtggattttgttcaggacccgtatttcacggaaaaatcagttgaaaaagaaaaaggcatcatcggtcaggaaatcaatatgtatgatgataatccggattggcggctgtttttcggccttattgaaaatatgtataaagaccaccccgtgaaaattgacattgccggaacggtggagagcatctctcatattacgaaagatctgctgtatgagtgctacgaaacgttttatcacccgagcaatatgctgctctttatcgtcggtcccgtagatcctgaagcggtcatcagccaggtgcggaaaaaccaggagaaaaagccgtttacagaccagcctgaaatcaaacgtaaagaggttcaggagcaggaagcggttttccgccgggagcaggaattaaaaatgaacgtgcaaggctcaaaatgtcttgtcggcttaaaggcgaaagacccttataaaacggggcgggagctgttgaagcacgagctcagcatgaacctcatgcttgaatgtctcttcggaaaaagctcaccgcattacggcaacttgtacgataaaggctacattgatgaaaccttcagctttgattacacggctgaatacggattcggttttgcctctgtcggaggagatacaccggagccggataagctcgctgacgaattaaaacagatgctgcttgatgcagaatcagccgtgactgcggaaaaacttgaccttgcgagaaaaaagaaaatcgggtcatttttaaaagcgctcaattcacctgaatatatcgccaaccaattcacacgctacgcctttttagatatgagtctgtttgatgtcgtaaccgtactggagcagatcaccctggaagacgtaaagcgggtcattaaagaagaaatatcagaagacaggctgacagtctgcaaagtcgtgccaaaatcataacaaaacatccctcacgccctgagggatgtttttctggggaaagaaggagtattgattgatgaaacagacagcgctcgtaaccggagcaagcggcggaatcggacaaagtataagtgaagtcctcgcaaaaaacggatatgacgtccttttgcattatcattctcataaggaagccgcacacaggcttgcggaaaggctgagcgcatcattcggcgtaaaagcctccgttatacaggcggatctgtcctcaccggatggcgcggagacactcagccgttccgttaagcagcctgtggatgctctgatattaaacagcggcaaaagtcatttcggcctgattacggacgttacggatgacacggcgcgggagatggtgcagctgcatgtgacgagtccgtttcttttggcgcgtaatctggtgcccggcatgatccggaaaaaaagcgggggcatcgtcgcgatcggttccgtctggggagaaacaggcgcatcgtgcgaggtattatacagcatggtcaaaggagcgcagcattcgttcgtcaaagcgcttgccaaagagctcgctccgagcggcgtccgcgtgaatgcaatatcgccgggtgccgttgatacaaatatgcttgatcagttcacgtctgatgaaaaagaagcgttggcagaggaaattcccgcgggccggctggcgaagccggaggaaatcgccgaagcggcggcctttttattatcggacaaggcttcctatattacggggcatatattatccgtaaacggcggctggcactgctgaaaaaatgtgtgtatagtttgcatctgcacggacaaaataattttgtaacaacagatgaaatggaggaacccaacatgtcagtattagaaaactgggataattggaagaatttccttggcgacagattgaactatgcgcaggaaaaagggatgagtgatgaaacaatcactgacctcgctacagaaatcggcggttaccttgcgaacgaagtcgactcgaaaaaccatcaggaaaaagtgcttgctgatctttggagcgttgcttctgaagatgaacagcgcgccatcgcaaatatgatggtgaagcttgttgaaaataacagcactcattaagaggggggatttctcctctctttttttatgttttcctctatagagcaacattcttctttctaattagagaaaaatgttttatgataaaggaaggtaaaaatttgccacaatggagggggtatatcatttggcaaagctcgaatggtattttgaatatgaaattcaagtgaaccgccccggcctgctcggggatatttcatctcttctcgggatgctgtcaattaatattgtcacaattaacggtgtcgacctttccagaaggggaatgctgctcagatgccggcatatagatcaaattaaacgattggaatcaattttaaaaacaatggagaccattaaagtaacgaagctgagagaaccgaggcttcgcgaccgtctcgcagtccgccacggaagatacattcagcgtgatgccgatgacaaaaaaaccttccgttttgaaagggacgagctcggtcttctggttgactttatggccgagctgtttaaaaaagaagggcacaaactgatcggaatccgaggaatgccgagggtcggaaaaacggagtccatcgttgcgtcaagcgtttgtgccagcaaaagatggcttttcgtatcatcaacgctgctaaaacaaacgatccggagccagctggttgccgatgaatacagcacggaaaacgtgtttatcctcgacggcatcgtttcgacaagacggggatctgagcgccatcttcagctcgtcagtgaaattatgcggcttccggcgacaaaggtcgtggagcaccccgatatttttgttcaaaattcggagtatacgctcgatgatttcgattatattatcgaactcagaaatgatcctgacgaagtcattacatatgaacatgcagaagaaccgcaaatgtttgatcagaccggtttttcaagctttgatttttaatattggaaggtgtttgttgtgacagaattagcaatccggcttaaagaagccagagaggaaaaagggatgtcattggatgaactccaggcggcgacgaaaattcagaaaagatacttaaccgctctggaagaaggcaattatgacgtcattcccggcaatttttatgtgcgggcgtttatcaagcaatacgctgaagctgtcgggcttgattcagatcagttatttgaagaatataaaaaagacatccctaacacgtaccatgacgatgtgtcggaaaaaatctccggtctcgccatgcaaagggagcttcctaagtccgcttcaaaggcggcggaatggcttccgaccgtccttgtcgtcatcggtgtcattatcgtcatcgcgatcatttatgcgattattcagttcggaatgagcaaatccgggcagacagacggagataaggccgtcacccaaagtgagagcaagtatgagattcctaaggattctgcgctgaaaaacgacggcaatacaaacgacgaagcgcaatctgacagcaaaaaagacaaaaaggacacaaaagcgtcagagcagaaaaagaaagaaaaaagcagtgataagacggagatcaaagcggccggaacggaaggctcggcttcttcatacaacgtctccggggcagataagtataagcttgaactgattgcttctgacagcgcatggatccgcgtccgtgatgacagcggcggttctttaaaagaaggaacgctgcaaaaaggcgaaacctttaaaaaagacgtcacggatcaaaagcagattgaaatccgcacgggctatgcccctaacctgaaaattaaaatcaacggagaggttctgtcctatgaactcaatccgcatgatgtgatggcgcagaccatcacaatcaagatgaaaaaacaaaaggggaaaagtcatctgaacgattaagatgactttttcttcacgtccgagtacatattattggaggggctttatgtttaacttaccgaataaaatcacactggcaagaatcgctttaattcctgtatttatgattatcatgcttgttccttttcattggggcagcgttcatataggggatgaatcgattccggtcgcgcatcttacgggagctgttttattcattatcgcatcaacgactgactgggtggatggctactacgccagaaaactgaacctcgtgacaaacttcgggaaatttttagatccgctggctgacaaactgctggtgtccgcggcattaattacgcttgtgcaatttgaccttgcgccggcgtggatggtcatcatcatcatcagccgcgaatttgccgtaacgggattaagacttgtgctggcgggaacgggggaagttgtagccgccaatatgctggggaaaattaaaacatgggcccagatcatcgctgttgccgcgcttttgctgcataatcttccgtttgagctcgtttctttcccgttcggcgatatcgctttatgggtggccgtgctcttcacagtcatttccggctgggattattttgcgaagaactgggatgcgttaaaaacatctaactaaggaagaaggacttaaagatggaaatagcaaaaaaagcagaaatcattgcggtcggctcggagcttctgctcggccagatcgccaatacaaacgcgcagtttatcagtaaagagctggcggaaatcggtgtaaacgtgttttaccataccgctgtcggtgacaatccggagcggcttaagcaagtcatccgcattgccgaagagcgctcagatctgattattttttcaggcggcctcggaccgaccaaggacgatttaacgaaagaaaccattgcaaacacactggggcgcccgctcgttctgaatgacgaagcattccggtcgatcgaagaatatttcgtgaaaacaaaacggaccatgtcgccgaataaccgcaaacaggcgctcgttattgagggctcggacgttttggcgaatcatttcggcatggcgccgggaatgcttgcagagcacggctcaaggctttatatgctgcttcccggaccgccgagcgagctgcgtccgatgtttgaaaatgaagcgaagccgctgcttcttaaaaagctcggttctaatgagaaaattgtttcaaccgtgctgcgttttttcggaatcggtgaatcccagcttgaagctgatttagaagatatcattgacgcgcagacgaatccgacgattgcgccgcttgctgctgacggcgaggtcacgctgcgtttaacggcgaaacatgctgacgaaaaagaaacagaacggcttttaaaagaaacggaagccgccattttagaacgtgtcggtgaatttttctacggatatgatgatacgtccctggtgaaggagctttcaaaagcatgcagacaaaacaaaatcacgatttcttctgccgaaagctttacaggcggcctgttttcagagtgggtgactgatttaagcggtgcgtctcaactatttgcagggggcgttgtctgctattccgacagcgtgaaacagcatgtgctcggcgtgaaagctgagacgctcgcagaaagcggagcggtcagcaaagagtgtgcgaaagagcttgcagccggtgtgagaaagctgaccggaagcgatatcggcatcagctttaccggagttgcgggccccgatccgcaggaagggcatgcgccgggccgcgtctttatcggcatttcagcggaaggaaaagaagaggtgcacgaatttcactttgccggctcaagaaccggaatcagaaagcgcgccgctaaatacggctgccatctcattttaaaaatgctggatcaaaaataaagttttaaagagccgttttctctgatttttaagttttataagggaacttatgctcttttgcagaaaagcgaacgcggaaaaaatccgaatatgcgttcgcttttttcttggcaaatgccagtaaacaaggtatagtatatgtagtggcaagataaaggaggaaaaaataaatgagtgatcgtcaggcagccttagatatggctcttaagcaaatagaaaaacaattcggcaaaggttccatcatgaagctcggagaaaaaacggatacaagaatttcaacggtgccaagcggctcccttgcacttgataccgctctcggaataggcggatacccgcgtggacggattattgaagtatacggacctgaaagttcaggtaaaacgactgtagcgcttcacgcaatcgctgaggttcaagaaaaaggcggacaggccgcatttattgatgctgagcatgctcttgatcctgtttacgcgcaaaagctcggtgtcaatatcgaagagcttctgctttctcagccggatacgggagagcaggcgcttgagattgctgaagcgctggtgcgaagcggagctgttgatatcgtagtcgttgactctgttgcggcgcttgttccaaaagctgaaattgaaggtgacatgggtgattcacacgtcggtttacaggcgcgtcttatgtctcaggcgctccgtaagctttccggcgccatcaataaatctaaaacaatcgcaatctttattaaccagattcgtgaaaaagtcggcgttatgtttggaaatccggagacgacaccgggcggccgcgcgctgaaattctattcttccgtgcgccttgaagtgcgccgtgccgagcaattaaagcagggtaacgacgtcatggggaataaaacgagaattaaagtcgtaaaaaacaaagtcgctcctccgttccgtacggctgaagtggacattatgtacggtgaaggaatctccaaagaaggggaaatcatcgaccttggaactgaactggatatcgtgcaaaaaagcggttcgtggtattcttatgaagaagaacgcctcggtcagggccgtgaaaacgccaagcagttcttaaaagaaaataaagacatcatgctgatgattcaggaacaaatccgtgaatattacggtttagacaataacggtgtaacggacaaagcggaagaagttcaggaagagatggaattagaagaataaaaacacgatcaaaagagcggagtaagcaatttccgctcttttttttgtgtgtttcaaaaaacactggctgtttcggaaaattttatctggaatgttacaacttttttcacccttcactcgtctaacatcatggcgaaagttgaaattatatctgaggaggaaaaaagatgacgagcccccgccgcacaagaataaataaaaaaagaaagaagaagctgatgaaaacgggagggctgtttctttttctgctgcttgtcactgtttttattatgatctggaccgtcacagcgcatcatcgggagaaggaatccgttaaaaatgctcccgccgctcaatctgatacttcaaaagaccagactcaacagaaaaaagaaaagacgcaaaaagagaaaacacctaaatcaatcgatcgcaataaacagatcagcaattacttgcaacagatcgggttcagcggcacagcaatgatcgtaaaagatggaaaagttgtgctgaaaaaaggctttggctatgcggaccgaaaacaaaaaattaaaaacaatccggagacatcatattatatcggttcttcacaaaaagcgttaatcgcgacggctgtcctgcagcttgaagaaaaagggctgctgcagacgagtgaccccgtcagtacatacttgccgaattttcctaacggcacgcgcattacattgaaaaacctgctcaatcatacgtccggcataaacgggcatattgagggtcggggaccgatttctccaattgatttaatcaaggatatagaataccgcggaattaaacggcagcccggggtttgggattacagggattccaactattcagtgcttgcttatatcgtatctcaggtcagcggggagtcttatgaacaatatataaaagaacacgtgttcaaaccggccggaatgaagcatgccggattttacaaaacatttgctgaagctaaatatcctgccgtcggctacaaagtcgatgagagcggcagtcttgtaacgccgcaccttttggatttatcgcagctgtacggggcgggcgatatgtatatgagcgctgaagatctctataaatttgataaagcgatcgtaaacggcacgctcctttcaaaagaaagcttcacaaaaatgtttacagcaggaagcagtgccgcttacgggatggggttttacattgatccgggaagctattccaatcacggtgttatgcccggttacaacattttgaacagcttcagccattcggcaagcaaatatgtcatattactgtcaaacattcagaataacgccaaattaggacaggtaaacaatagaatttaccaattgcttaaccaggcggactgacagagccgtcattcacgaaaagcggatgaaggtatggtatgatatatacatgggcggcgatccgagctgaaggcgaatcgttaagctggcaagcttgacaagtatttccgacacaattacaatgaagttgtaacatttgtttttttaacatgattgttaaaccatttaaacttgacaagggcatgagagactcattccctgtgaaggttctgtatgttgagaaaatcagacaatgtacatgccggcacttatttaagcaaaaaccaagttcatagcaagaggaggtgaaagtatgaccccaatgacggttctcatctccattttgctgactctgctcggtttagttgttggctactatgttcgtaaaaccattgccgaagcaaagattgcgggcgcacgcggtgctgccgagcaaatccttgaagatgcaaagcgtgatgctgaagcactgaaaaaagaagctctgcttgaagcaaaggacgaaatccatacacttcgaatagatgctgaacaggaagttcgtgaaagacgaaatgagcttcaaaaacaagaaaaccgtttacttcaaaaagaagaaaatcttgaccgtaaacacgaaggaattgataaacgggaagcgatgttggagaagaaagatcattctctgaatgaacgacaacaacatattgaagagatggaaagcaaagtggatgagatgattcgtatgcagcagtcagaactcgaacgcatttcgagcctgacacgggatgaagcgaaacaaatcattcttgaccgggttgaaaatgagctttcacatgacatcgccatcatgacaaaagaaaccgaaaaccgtgcgaaagaagaggcagataaaaaggcgaaaaacattctgtcgcttgctttgcagcgctgtgcagcagatcatgttgccgaaacgacggtatcggtcgtcaatcttccgaatgatgagatgaaaggacgtatcatcggccgtgaagggcgtaacattcgtacgcttgaaacgcttacaggtattgacctgattattgatgacacacctgaagcagtcattctttccggatttgatccgatcagacgggagacggcaagaattgctcttgataaactcgttcaggatggccgtattcatccggcgcgcattgaagaaatggttgaaaaatcccgccgtgaggttgatgactatatccgggaaatgggtgagcagacgacgtttgaagtcggcgttcacggacttcacccggatctgatcaagatcctcggccggttgaaattccgtacaagctacgggcagaacgtactgaaacattctatggaagttgcgtttttagccggtttaatggcttccgagcttggagaagatgcaaagcttgccaagcgggccggtcttctgcatgacatcggaaaagcaattgaccatgaagtggaaggaagccacgtggaaatcggagtggagcttgcgaccaaatataaagagcatccagtcgtcattaacagtattgcgtcacaccacggagacgaagagccgacttccattatcgccgttctggtcgctgccgctgatgcactgtcagccgcaagaccgggcgcgagaagtgaaacgctcgaaaactatatccgcagacttgaaaagcttgaagaaatctccgagtcttacgaaggtgttgaaaaatcatttgcgattcaggccggccgtgaagttcgcatcatggtgaagccggactccattaatgatttagaagcccatcgtttggcgcgtgatatccgtaaacgaattgaggacgagcttgattatccgggccacattaaagtgaccgtaatcagagaaactcgagccgtagagtatgcaaaataaagtgatgcttagcgcatcactttatttttttgagtccctgaaaaggaaggaatggaatgtatgagaattttatttatcggagatgttgtcggttccccgggccgcgacatggtaaaagaatatgtcccgaaactgaaagcgaaacataaaccgcattttacaattattaacggagaaaatgcagcacacggaaaaggactgacggaaaagatctaccacagcctgatggaagcgggagcagatgctattacaatgggaaaccatacgtgggataaaagagagatcttcgactttattgatgatgtgccgcatcttgtccggccggcgaatttcccggaaggtacgccgggcaaaggcattacttatattaaatcgaatggaaaagagcttgccgtcattaatttacagggacggacgtttcttccgccgcttgatgatccgtttgctaaagcggatgaattaatagaagaagcgaaaaagcgcacaccgtacatttttattgattttcacgccgaagcgacaagcgaaaaaattgcgatcggctggtacacagacggaagagcctctgccgtggtaggcacccatacacacgtgcaaacggcagataaccgcattttgccgaagggaacggcatatattactgatgtaggcatgacgggtccgtacgacggaattctcggtatggacagagaaacggtcatcaagcggtttaaaaccaatcttcccgtccggtttacggtggcggaaggtaaaactacgctgagcggagtgctcattgacatcgacgatcaaacgaaaaaggccgtaaatatcgaacggatattaatcaatgatgaccatatgttctttgaataggtgatcatgtgtttattttataaaaatattaaaaggaaaagcaggaatatagcaacttcttagtgaatatagtagaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcaagtccaaattcagtagcaggcgcgcttgccggcgtattgagggaacgcggagccgccgaaattcaagcaattggggcgggtgccttaaaccaggctgttaaagcggttgcgattgccagaggctttgtcgcgccaagcggcgtagatttgatttgtattccggcttttacagatatacagattgacggagaagaaagaacggcgattaagttaatcgtcgaaccccgttaaaaacaaaaacatgacattctcaacctgcttgcgtaaggcgagcaggttgtttttattgctgtcatattttctcacaatattatattaatagtacgaagagatgataaatggctttattcatataatattcaaaaaaaatcccgcccatttttccggacggaagcagttgttttcttggagtggacactggtatttacctcctttttaactcatgttacaatccagttattacagtgttttttcgaggaggagtgtacatgttgggaggaaagatgaaagctatcgtcaaaaatgaaaacgctttcggagcaactctgaaagaaattcccataccttccattaatgagaatgaagttctcattaaagtacaggccgcatctatatgcggtacagatgtgcatatttataattgggatcaatgggcgcagaaacgaatcaaaacacctcaagtattcggacatgaattcagcggtatcgtagcggaaacaggcaagcacgtcacaaatgtcaaaataggtgactacgtttcggctgaaacccacttcgtctgcggtacttgtgtcccgtgtttaacaggaaaacatcatgtgtgcacccatacaaagatactcggcgtagatacagccggctccttcgctgaatatgtcaaagtgccggcccgaaatgtttggaaaaaccccgctgatatggaccccgccgtcgcctctgttcaagagccgcttggcaacgcggtgcatacggtgctggaaagcagccggcttgcgggtggttccgctgcaattatcggctgcggaccgatcgggctgatggcggtggcggtggctaaagcggccggtgcatcccgtattgcggccattgataaaaatgattacaggctggctcttgcgaagaaattgggagctgcgatcaccatttcagctgacgaggaagatccgcttgaggtgatcgacaccttaacaggcggagaagggatcgaccttgtctgcgaaatgtcaggccacccggcagccataacacaaggattaaagatggcggccaacgggggaaggttccacatgctgagtctgccggaacgtccggtaacggttgacctgacaaatgacgtggtgtttaaaggacttaccgtccaaggcatcacaggcagaaaaatgtttgaaacatggcggcaggtatcgcacctgcttgaatccggccttgttgatctgacgccggtgatcacgcatcagtttccgcttgaagactttgaaaaagggtttgacctgatgagaaagggacagtgcggcaaagtcattttgattccataaggggagggttctatcatgaaagaatttgaatttctaaaagcagagcttgataaaatgaaagaaaataaaacgtggcagcaaatgaaacaaattgaaacgaagcagggtccgtcggtggaagtcaaagggaaaaacgtgatacagctttcatcgaacaattatctcggtttgacgtcgcatccaagacttgtcgaagcggccaaacgcgccgcggaagaattcggagcgggtacggggtccgtccgtacaattgccggaacattcacaatgcacaatgagctggagaaaaaattggcaaactttaaaaaaacagaagcggcacttgtttttcaatcggggttcacaacgaatcagggcgtcttatcaagcattcttacaaaagaagatatcgtgatctctgacgaactgaaccatgcttccattattgacgggatcaggctgacaaaagcagataaaaaggtgtaccgccatgttgatatggacgatttggaaagggtgctgaaaaaatcaatgaattaccgcatgcgcctgatcgtcaccgacggcgtattctcaatggacggcaacatcgctcctttgcctgacatcgtcaaacttgcagaggcgtacgatgcctttgtgatggtcgacgacgcgcatgcttccggcgtactcggaaaaaacggaaggggaacggttaatcacttcgggcttgacggaagagtccacatacaagtgggcacattaagcaaagccatcggagtgcttggcggttacgccgcagggtcgcaggttctgatcgattacctgcgccataaagggcgccctttcttattcagcacttctcatccgcctgcggtaacggccgcatgcatagaagccattgacgtcctgctggaagagccggagcatatggaaaagctatgggagaacacggcgtatttcaaagacaaactggttcaaatggggctgaccctcacaaaaagcgaaacaccgatcgtgccgatattaataggggaggaagaaaaagcccaggcattatcagaccttttattgacccgcggcgtgtttgcgcaaagcatcgtgtacccgacggtcgcccaaggaaaagcgagaatccgcaccattattacggcggagcatacaaaagaggagcttgaccgggccctggaagtaatccgttcagccgcaaaagagcttcagcttgtgtaagggggaaatgattccctcttttttatttcttattgattcttattctcaataaggtgtacaataataggctggcggttgtgccaaacgcttttaaccagtatacttgagggtggaagtttcggttgaaaggagacattcgaacatgaatgaaaagcaaaagcaggaaagcggacaagtgaatccggcggacaaaaaatccgaaaaggattacagcaagtattttgaagccgtatatattccgccttctttaaaagatgcgaaaaaacggggcaaagaatccgttcaatatcataacgattttaaaatctcagaagaatttaaaggcctcggtgaaggcaggaaattttatatccgcacgtacggatgccaaatgaacgagcatgatacggaagtcatggcgggtatttttatggcgctcggttatgaagcgacaaattcggttgatgacgcgaacgttattttattaaacacttgcgccatccgggaaaacgctgaaaacaaagtgttcggagagctcggccatttaaaggcgcttaaaaaaaacaacccggacttgattctcggcgtctgcggctgcatgtcacaggaagaatcagtcgtaaaccgcatccttaagaagcacccgtttgtcgatatgattttcggcacacacaacattcaccgtctgccggaactgttatcagaggcatatttatcaaaagagatggtcattgaagtgtggtcgaaggaaggggatgtcattgagaaccttccgaaagtccgcaacggaaaaattaaaggctgggtcaacattatgtacggctgtgacaagttctgcacatactgcatcgtaccgtatacccgcggaaaagaacgaagccgccgtcctgaggaaattatccaggaagtcagaagacttgcaagcgaaggctataaagaaatcacgctgctcggtcaaaacgtgaatgcgtacggaaaagattttgaggatatgacgtacggtctcggtgatttaatggacgaactgcgtaaaattgatattccgagaatccggttcacgacgagtcatccgcgtgactttgatgatcatctgatcgaagtgctagccaaaggcggcaaccttttagaccatatccatcttccggttcaatcaggaagctcagcgatgttaaaaatgatggcccgtaaatatgaccgagaacgctatctggagcttgtcggaaaaattaaagcggcgatgccgaacgcttcactgacgaccgatattattgtcggttttccgaatgaaacggatgaacaatttgaagaaaccctttcgttatatcgcgaagtggaatttgacagcgcatatacgtttatttactctcctcgtgaaggcacaccagcggcgaagatgaaagacaatgttccgatgagggtcaagaaagaacgtcttcagcgcctcaatgatttggtgaaagaaatttcagccaaaaaaatgaaggaatatgaaggcaggactgtcgaagtattagttgagggagaaagcaaaaataaccctgacattcttgccggctatacggaaaaaagcaagctcgtcaacttcaaagggccgaaagacgccatcggcaagattgtacgcgtcaaaatcgaacaggcgaaaacatggtcgcttgacggtgtgatggcaggagaagcaatcgaggtgaaataataatgacgctttactcaaagaaagacattgtacagcaggctaggaaccttgcgaaaatgatttctgaaacagaagaagttgattttttcaaacgcgctgaggcgcagattaacgaaaatgaaaaagtctctgcgattattaatcagattaaaaccctgcaaaagcaagccgttaacctgaagcactacgaaaagcttgaagcgctgaaacaagtggaaagtaaaattgacgccctgcaggaagagcttgaagggattccgatcattcaggaattcagagattcccagattgaggtcaatgaccttcttcagcttgtcgcacatacgatctcaaatcaggtgacaaacgaaatcattacatctaccggaggcaacctgctgacgggagaaaccggttcaaaagtaaaacattcgaataacagctgttctatttaaacacggggccttcatcggcccgtgtttttttgctgtttgagaactaattgtaatatgtactaaattttcatcatctcaacgttttgtcctatttttactggaaagttttatcatacttaaaagtaaagtttctgggcagggctgcatacaatgaaacagaaactttgtatttttatatttttattataaaaatgcacatgagacaaatgcccagcataagataacacgaagaagaacaaggaggcctgccggaatgtctgaatacagggaaattattacgaaagcggtagttgcgaaaggaagaaaattcacccaatgcaccaacacgatctcgcctggagaaaaaccgtcaagtatattgggcggctggattatcaaccacaagtacgatgccgaaaagatcgggaagactgtagaaattgaagggtattatgatataaacgtctggtactcttacgccgataatacaaaaacggaagttgtaaccgagagagtaaagtatgtcgatgtgattaaactcagatacagagacacaaattacttagatgacgaacacgaagtcattgccaaagtgctgcagcagccgaattgtcttgaagtcaccatttctcctaacggaaataaaatcgtggttcaggcagagagagaatttttagcagaagtggtcggtgaaacgaaagtcgtcgtcgaagtcaatcctgactgggaagaagacgatgatgatgattgggaagacgatcttgatgaagaattagaggacattaaccctgaatttttagtcggagatcctgaagaataagttgaggctaggggagtttaacaccccaagtctcttttttatatataaagatatcactcttttgtttatgttataatgggattcggataagagaagatacatagtgagggattaaatgatggctagttacacgcctatgatacagcaatacttgaagataaaggcagagcaccaagatgcctttttattttttcggcttggtgacttttatgaaatgttttttgaagatgcaaaaaaagcgtcgcaagagcttgaaattacactgacaagcagagacggaggttcggctgataaaattccgatgtgcggcgtgccgtatcattctgcggcggcttatattgaacagctgattaaaaagggctataaagtggcgatctgtgagcagacggaagatccgaaggcggctaaaggcgttgtaaaaagagaagtcgtccagctgatcaccccgggaaccgtgatggatggaaaaggcatccatgagtcggaaaacaactttatcgcttccgtttccgaatttcgtaacggatacggtctcgctttatcggacttaacgaccggagaaaacctggccgtatttattgagcggattgaagatgtcatgtcagaaatttactcagtcggcgcaaaggaaattgtcgtatcaagcaagtttaacgaacatacagctgctcagctgaaagaacggtgcagcgcaacgatttcgatcgaagacggggaaataacagaacgcattgaaatcgcaaagcacttgccgggcgaagagctgacagagacgtttatgcgtttatatacgtatttgcagaaaacgcaaaaacggagcctggatcatctgcagccggttcaagtatatgaattggaagaagcgatgaaaattgacctgtattcaaaacggaatcttgagctgacggaaacgatccgttcgaaaagcaaaaaagggtcattgctttggcttttagacgagacgaaaacagcgatgggcggccggcttctcaaacaatggattgaccgtccgctgatcagggcatcccaaatcgaagaacgccaggaaatggtcgagacgctgatcaatcatctgtttgagcgtgaagacctgcgcgagcgcctgaaggaagtatacgatttagaacgtctggcgggccgggtcgcattcggaaacgtcaacgcaagggatttaatccagctgaaagaatctttaaaacaagtgccgagcattaaagagcttatagggtctcttaaccataaaaaagcaaaagaacgcgccggcttgattgatccgtgcggagatttgcttgacctgttagaagaagcccttcatgaaaacccgccgttatcgttaaaagaaggcaacttaattaaagacggctatcatcagaagctcgatgagtaccgtgacgccagcaaaaacggtaaagactggattgccagactggagcagcaggaacgcgcttatacgggcatccgttcattaaaggtcggtttcaataaagtgttcggctattatattgaagtcacaaaagcaaaccttcatctgcttgaggacgggcggtatgagcggaagcagaccctcacaaacgccgaacggtacattacgccggaattgaaggaaaaagaagcgcttattttagaagcggaaaacaacatctgcgagctggaatatgagctttttgccggactgcgtgaaaaggtgaaacaatttattccgcgtctgcagcgtcttgccaaacaaatgagtgagctggatgcgctgcaatgctttgctacgatcagtgaaaacaggcattacacaaagcccgtcttttctgataatgaagtaaaagtcattgaagggagacaccccgtcgtcgaaaaggtgatggacagtcaagaatacgtgccgaacaactgcctgatgggcgattcgcgggaaatgctcctgattacgggtccgaatatgtcaggtaaaagcacgtacatgagacagatcgcacttctatcgatcatggcccagatcggctgttttgtacccgcaaaagaagcggttctgccgatttttgatcaaatcttcacgagaatcggggcagcggatgatttgatttccggacaaagcacctttatggtggaaatgctggaagcgaaaaacgcgattgtgaacgccacaaaagacagcctgatcctgtttgatgaaatcggccgcgggacatcaacgtacgacggaatggcgctggcacaggcgattattgaatatgttcatgatcatatcggcgctaaaacactgttcagcacgcattatcatgagctgacggtgcttgaagataagcttcctcagctgaaaaacgttcatgtgcgcgcagaggaatataacggaacggtcgtgtttctccatcaaatcaaagagggagccgcagataaaagttacggcattcatgtcgcccagcttgcggagcttccggacgatctgatcagccgggcgcaggagattttgaaacagcttgagcagacgggagataaaccggagcttccggcggcacctgagaaaaagcccgccgtcaaagaagaaccggcacagctgtccttttttgctgacggtgaaaaagaacagaagacaccggctgtttctaataaagaaaaacaagtgcttgaagcttttaagtcaatcaatattctcgatatgacgccgcttgaggcgatgaatgaaatgtacaagctgcaaaaaaaattaaaatagaaagaggtgacggacttggcaaaagtcatccagctgtcagatgaactctcaaataaaattgcggccggtgaggtggtcgaacggcctgcatctgtcgttaaagaattggtggaaaacgccatcgacgcaaacagcacagtcattgaaatcgacatagaggaagcggggctttcgtcgattcgggtgctcgataacggcgaaggtatggaaaccgatgattgcaagcgggctttccgccgccacgcgaccagcaaaatcaaagatgaaaacgacctgttccgggtgagaacactcggtttccgcggagaagctttgccaagtatcgcgtctgtttctcatctggaaatcaaaacgagcatcggcgagggagcgggaacccatctcattcttcagggcgggaatatcatttctgaacagaaatcctccagcagaaaaggaacggagattatcgttaccaacctgtttttcaatacacccgccagattgaaatatatgaaaaccgtgcatacggagctcggcaatattacggatgtcgtcaaccggattgctcttgcgcatccggaagtatcgatccgtctccgccatcaggggaaaaatctgctgcagacaaacggtaacggggacgtgcgccatgtgctggccgcaatttacgggacggcggttgcgaaaaaaatgataccgctccatgtcagctcgcttgattttgaagtcaagggctacattgcacttccggaaatcacgcgtgcatccagaaactacatgtcatctgtcattaacggaagatacattaagaatttcccgcttgtaaaagcggtgcatgagggctatcacacacttctgccgatcggccgccatccgattacgtttatcgaaattacgatggacccgattttggtcgatgtcaatgtccatccgtcgaagcttgaagtccgcctcagcaaagagacggagctgcatgagctgatccgtgacgggataaaggaagtgtttcaaaagcaacggcttattccgagcgcccagctaccgaaaaaatcagcgccggcaccggccaaaaacgaacagcaatttatgacattcgaggaaagcgcgcctgagcggaaacttcctgaaaaaacgcctgagccgtcttactcaccgatgaagctgagttcggtcgtaaaagagcctgagccggtcatagaagaagagtccctgaccgatgaagcaggtcacggagtgccgccgaagatcggcatgccggtaacggaagcgcctgtttccgatattccggagcctgaagtggaggctgactctgaagaaatacgggaagaaagagttccggtgatgtatccgatcggccaaatgcacgggacatatattttagcccaaaacgaaaacggcttgtatatcattgaccagcatgcggcgcaagaacggattaaatacgaatatttccgggagaaagtcgggcaggtcgagcctgaagtacaggatatgatcgtgccgctcacctttcattatgcggcaaatgaagcgctgatcattgaccagcatcagcatgagcttgaaagcgtcggagtatttttagaagcattcggcacgaacagctacatcgtccgctgccatccggcctggtttccaaaaggggaagaagctgaactgattgaagaaatcattcagcaggtgcttgacgccaaacagatcgatattaaaaaactgcgggaggaagcggccattatgatgagctgcaaaggctcaatcaaagcgaaccgccatttgcgcaacgacgaaatcaaagcgctcttggacgacctgcgccgaacgacagacccgttcacatgcccgcacggccggccaatcattatccaccacagtacgtatgagatggagaagatgtttaagcgtgtgatgtagcagggttctgggtgggatgcacccctcgtgcccacattttgcccactgattttagctgtttaggtatttatcaaaacgttaatgctgtatatcttttcaaaagccgcgaagggatcaacaagcccatttcccggtcgatggcttataagattctaagggctgccgctgagtatgtcggtttggacgatataggcacacacgctgaggaaaacattcgggtaccatttttacaagcaaacaaaagatgttgccatgctgcaggcgattttcaatcactcggaccagcggacaacccttcgatacattggaatcaatcaggatgccatgaacaacgccatgaagaaattcaagatataaacaggctcatctcataaactagatgagtcttttttctgcatatttttattgattcccttcaaaaagcaaacgtggaattcattttagggatatcgcttgaaaacaagggtggcaagggctgacggaactcggcagttgcacagtctataacatatgggtaatccgtggattttgtggataaatggaaaatttgggcgtttttcgtgatattattgtgttacagaaggtgagcggcatgaatagaggcgcaacaggttcagcgttagaagagaaaggcatggtttgatagaacgataccaagtaatgaaggggtgagcgggatgactgcagcagagcaaaaaggaatgtactaaaaagattttggcagaaagttggcacgataacggcacaccattttgttttagataaggtattatggtagtaggtaataaatcaagggagcggcactgctgatgagcggggtcgctttttgttgaggagggataataatgagcagcattggaacaccgtcaaaaggtttcgaaaacttcgacgtaacttgcaagggctgcggatcaaagaaccgacactgggttcgaaaattggatcgtatgtcgaatttacctactacgaagacatctgataacgattaaaatacggaggtgttctcgttgttgtatatacaaactaaagaaatgccgaagaatgaaaaagatttctctgcggaaaaaattcgatgtgatacggatgaataaacaggagggggagtagttaacaagctgctccccagttcaactataaacaaatttctataaaatcttcacatagaggtgttttggtacagattccttttttaaaatcaagcttagtaaactctggatcaacatctcttatttcaatcaatctctggttagcttcttcaagcacaggatgagaagaaatataatcatagtattctggattcccggatcgtactgaataatcaacagctaataaacctactctttggagattagatattgatgaagcttgagctttataatcaacttgatctttaaaattcaaaatatgttgttgaataacaacataagtacctgcatcatttttagacgcgtcaactcttattgctggaagttgttgaaattgtttaaagtttatcaagatggctgcatctaatggcgataactgtttgattatctctacaaatgaaggatgaactttggaaaattttctactatctatagtagaagaaataaggttggcaaacatttctcgtagttgttctgaatcaatatagaactttgaagcttctatagcaggtcctactatattgagttctggttctttaagaaactcctcaggaataacttgagttttattttgcaccttataaacatagtcctcaaaattttgcttatggcgaaattcttgtttcctagaccatagtgacacgtgattgccaattcctaatttccataaatccgttaatgtgtcacctactgcctgcgctggtttgccggcagcattatcaataaactttggtagaatacccattttttaatccccccttatactagtataggaggaaagtctcgtggaaacaatatacaatcatccttttctaacatcatggtttatttttcttgcaggattttggctgacagtagctttagggcaagtcataaagaatagcattcttcagggtgttttttatgttctctgtaaactgcgtccggtaaatctcaggttagactattagcggttaacggcggcttgagcgcgagggcagtttagaaagaatatatcaagcgctttccaatcgggagggcgctttttctattggagggattaaccatgtctgaagacaatttatatgttgatcaatttaaagcgtggtgcactgagcaagagcttcttttaaaacagattaattatgacattgaaatcagtaaaaggaaaatcgaattgaacgagaaacaaaagcagttgcatctggaacgcgtgaatataggaattcaggaattcaataattgggcaaaaacttctaatcgtgacgaaagactggagttactgaaggaagatcaaacagatgctactgaaacacttttttgtgatggtcaggaattcgcaactatacatggaaagaatatgaaggaggatgaacagacttgaaaattccagttgttaaaacggatgtacctcttgatagaagagcaaaagaaaaaatgcgcatggaaattgaaaaggcaattaaaacaggcatcgtaattcttgatggagggttagaccttgcaataattgaagttgaagactccaatattgttaatgaaacgtttatagaagcgaagactttttctcctgctaaaggcgagacagaagctgttgaatatattggtgggccgataattggcagttgtgtctcggaaggagtgctaaatcacaaagaaccagaacctttaaagacatcgaaagcaacgcctttgctacagattgagcttgatgacattacttccgttccgcgtgttttatataaaggcgaagaaataaagaataaagtccgtgtagatttctcttatcttactggggatgagtatgggatcaaaccgatttatattgacattgttgctcatagagaagatggatcagtaagaccaattagccataacctaggtgcaataagcataaatgaaaaaaggctcaagtgatgttttctttctattaaatctttgaggaggaataacaatgaatataaaggttacaaaggataaggcatcatgcctcttaaacctctaaggatatgcgctgcccgcgggtgttccagcctcacccgtgaccggtactgtgatacacacaagacacaacgacaagaagaaacgaaacattacaacaaacattcaagaaacaaaacaataacaagtttttataaatcaactgaatggaaacgaacaagacaacttgctttgatacgagacaattatctctgtcagcattgtttgaaagatcattgcttcactccggctgacatggtgcatcatattgtggaagtaaagcaagattggtcgaaacgattggacataaagaaccttgaaagcttgtgtaacgcctgtcacaacaaggctcacggcagtaagggcaagtgaccctctccccctaacaaatctctggaagggaaacgaacggagaacggcgatcccccttctgcaaacaaacaccgcttttcaaagttccgaaaacagcagaaagccccctcagcaaatttgccgagagggcttggtacgactggttttgttgttaatttcatcgtaacacgattggcgaaaaaaacaagcgaaaaatgcaacttttttgacatgaaatgaggtgagtacatgccgaggcctgcaaaatccgcgacgcttcaattgatacaaggcaacccaaataaaaagaatacggaagagttggcagcccggactgagcacgagaaaaagacaaaaggcgatccgataatataaaaccgccaacgtggttggataaagtcgaaaaaaaaggaattcaaacgagttgctgctttatgcgatataaacattgtttatggacagcatttggtttgacagctcagaatgccgtgtttggtgtgatcgtctatatcgtcaattaatagtgaaataatgaagaaacccattcctgaaaatctgaatgttactcgtgaaaaatctcttaaagggctacatgattatcatgagtacctgcttttacaaattcacagggagatgggggaagaatttaaatcagaatggaatttggtgagctgacaatctaaaagagtcaaaggggactagtaattagcccccttacatttagttcttcctgcggttttttctatttttgatcaaactgaaaaccactaagagaactacaccgacagcaacaatataaaatgaaatttccgctgcggcggtgttaatattcttaaggacaaggataagccctattaaaattataggaatgatgtaagttagaattcttatagcttttgggctcggttcagcgtttcttttattttccataattacctcccgtctaaagtttaacacaggttaaatttgataatcaccaacaatagtcccgtttaaagaggaaacataagagtttaagtaatccatcaagcggcgtacgtgccgtttggtccagaagatgctttactctagcataaaagattactcaggggagaatgctccggcgttctaagttttggactgtattctggcaaaagaaagtgaagaaacaacatcttgtgtgtgaattacgtcgtatctttctaattcgaattgtgtgttaatgccaactcataaacataacattgaaattcggtgtaaggagctaatgtattctgatatattttgaggaagccgccgtaggggtttagtttagcttgaagaaaaggattgaaatataccatccttcattttctgaataaaattacctgaagaattcatctaaatgaacatcctgatttcctgatatatcagcatagcaatttgtaaaaaaggcccagactggtgcttttggcgggagcagaaagttttttaaactttaccggaaaatccatggaaaaacgtggtgccatctggtaaagtggttacagtcggctgggcggcggcagcagtctgcccggatcttttaaatgggaatggtgacaatggatcatacatatgaagtgcatcaaatcaaaacttatcaccagatgtggtccaactattgttatattatcgcagaccgctcaaaaaaatctgcgatagcggtggatccgtcctgggaaatcgataaaataaccgataaactgcatgaattggatgttgatttatcagctattttattaacacattcgcattatgaccatgtaaacttggcggagccgcttcagcaaatctatcattctgatatatacatgtcgtcggcggaaatcgatttctatcaattccggtgcagaaacttaatagcgcttgaagacggccaaacctttgcggccggagggtttatcatcagaagtatactgaccccgggacatacggccgggggaatgtgctatttgctatctgatcacctttttaccggtgacaccgtgtttacagaggggtgcggtatatgtgaggacaggggcagctcagctgaagatatgtttcacagtatacagaggatcaaagcctctattccgccgcatgtgcgtgtgtatccggggcactccttcggggagaagccgggtcaaaaaatggagagtcttttgaaaaacaatatttactttcagattgaaaaaaaagaacatttcgtgaatttccgcaacagaaaaaatcaaaaagggctgtttcattttaagtagcgtataatttggttctatctaactagtttttcttttggggcacggaacttctgaaatgaaatgatagttattgctcgcttttgggtgatgaatggctgagtaacggtagtttgcggataaaagcgccgggcaggccgaatgggacattctgcttacgtctgttccaaaagccctgagtccgccttccgtcagggaaaaataggcattattcaggattccgcataggataaattaacttgacatggtatttttgtgaagttactatcaacttgaacatgcttcttaactgaatccgagaaaggatggctgagaaaatgatcacatacttattccccggacaaggttctcaaaagcagggaatggggagctcattgtttgatgaatttaaagacttaacggagcaggctgatgaaacactcggatattccatgaaacggctttgtcttgagaatccgtattccaaccttcacaagacgcagttcacccagcctgctttatatgttgtaaacgcgttaagctatttgaaaaaaatccaagataatgacataaagccggattatgtggccggccacagtttgggagaatataatgcgctgtttgcagcaggtgcttttgattttattaccggcctgcagcttgtccgtaaaagaggcgaattaatgagtatggccactgacggaaaaatggccgccgttatggggttaactgcagctcaagtgtcagacgcccttcaaacgaacggattacatacgattgatattgccaatatgaattctcctcaccaagttgtcatatccggacgcaaagaagacattgaaagagccaaaagcgtattcgaaggattaaaagacgttacgatgtttcatccgttaaacgtcagcggcgcttttcactcgagatatatgagcgaagcaaaacaagagttcgaaaaatttttacagtcatttcatttttctgctatatcaattcctgtcatttctaatgtgcatgccagaccttatgagcaagacggaatccactccgttctggccgatcagatcgaccactcagtgcgatggaacgacagcatccgctatctgctggacaaagggcggatggaatttgaagaagtcggcccgggccatgtgctgacaggacttattcaccgcatcaaaaaagaaactgaagcttcacccgccatgtagcggaacgcaagtcaaaattcttatctcacacaatagtgccagccatacaacatcacgaccacttcacctgcacacgacatcacgaaaaacgtacaaatcaatattttaaaaaaataaagagcaaaaaggagaacaaatgaaccagccaattgttttcatgttttctggacagggttcccaatactatcaaatggggaaagagctgtttgcacataacgccgcttttcggcagaaaatgcttgacttggacgattttgcagtcagccgtttcggttactctgtcctgaaagaggtttatcatacaggcaatcgtctgtctgatccatttgaccgccttcttttcagccatcctgccatttttatggctgagtacgcacttgcatatgctttggagcaaagaggcatacgtcccgattatgtgatcggagcaagcctcggagagtatgcagcagccgctgtatcgggtgtgctgagcgccgaggatgctttagattgcgtgctggaacaggcccgaatcattacggaaacttgccgtaacggcagcatgcttgcgatactgggtgatccggctttatatcaagatgatccgctgctcggcgaacatagtgaattggcatctgtaaactatcattctcactttgtcatctcgggagagcgggaacatatcaaaaagatcatggacgatctgagagagaagcagattcctcatcagctattgccggtatcttacgggtttcactcagcgctggttgatcaggcggaacagccgtacaagcgttttttagctcagaaatcaatccggactccgtttataccgtacatctccagtgcgaccggagaggctgagaccgatatacaagcggactttttctgggatattgtaagaaagccgattcgattccgtgaagcgcttcaattcgcagacagccgccaaaaaggattgtatatcgatgccgggccttccggaacgttggccgcatttgccaaacagattcttcccgcaggatcggctgaacgcatccgtgccattatgacgccgtttcataaagaacaaacccatttgcagcaaatagaagacagcattttatcaccgcccggaaggagactgtaagatgatcagctttgtttttccaggccaaggctcgcaaaaaatagggatgggagaggacctgttcggccgctatcctgaattaactgcaaaggccgatcatattctcggatattctattcaggagctgtgccgggacggagaacgtctcaatcagactcaattcactcagccggcgctctatgtcgtcaatgccctcagttatttgaaaaaaacagaagaaaccggcttgaaaccggattttaccgccggacacagtttaggcgaatataacgcgttatacgcctcgggcgcctttgattttgaagaaggcttacagctggtcagaaaaaggggcgaactgatgagccgcgccaaaggaggcggcatggcagcggtgatcggcctgactcatgagcaggtgacggacgttttaaaagagtatcacttgcatatggttgatatcgccaacatgaacacaccgcagcaaattgtcatttccggatataaagaagatattgaaaaagccgcatccgtttttgaagccgtaaacggcgtaaaaatggttcaccgcttaaatgtcagcggcgcctttcattccagatatatgatggaagcgaaggaggaattttcacggtttattgaaactttccattttaagccgctgtccatcccggtcatttcaaatgtgacggcaagaccatatgagcagaccgagctgaaagagacactcaccggacaaataacgggatcggtgaactggacagacagtatccgtttcttaatgggaagaaagaacatgagttttgaggaaatcggtcccggaaaagtgctgacagggctgattcaaagaattacggctgaagcggagccgataacagatgaaatcaaagtcccggctgaggctggaaaaagctcaattacggcggcgtctttaggaaatgaagagtttaagcgcgattatcaattgaaatacgcctacttggccggcggcatgtaccgcggaatttcttcgaaggaaatggtcgtcaaactggccgaaaaaggaatgatgggctttttcggaacgggcggtttgaacatcgcgcacgttgaggacgccattttgtcaattcagcatgagcttcgtgacggcggttccttcggtattaatgttgtacataacatgaagcatacagattcagaagaaaaaatgattgatcttttactgaagcatgggattcagaacttggaagcatcagcatttttaacggttactcccgctttagtaaggtttcgcgctaaggggttaaaacgcggtgccggcggacaagtaatagcgcgtcagcggattatcgccaagctgtcccgtccggaagtagcggaagcgtttctcagcccggcccctgatcacattctgcagaaacttgcagccgaaaacaaaattaccgctgaagaagcaagtctgatgagagaaatacccgttgcgcatgacatctgcgtagaggctgattcaggcggccacactgacggcggagttgcttacagtctcatgccggcgatcatccgtttacgagatgacatgatgaaaaaataccgatacggcaaaaccgtccgcatcggagccgcagggggaatcggaacgcctgaggctgctatggccgcatttatgctcggcgctgattttattgtgaccggatccattaaccaatgcaccgttgaagcagcgacgagcggcctcgtaaaggatctcctgcagcagatgaatgtacaggacacggcctacgcgccggccggcgatatgtttgaatcaggcagcaaggtgcaggtattaaagaaagggctgttctttccgacccgggcctctaagctgcatgaactgtatcagcgtcaccgctcaattgaagaaattgatgaaaagacactcagacaaatagaagagaagtattttaaggcaagtgtaagcagtatttatgacaaagtgaaggctcattattcgaatgaagacatttcaaaagccgaacggaatccgaaacagaaaatggcgctcatattcaaatggtatttcaggcaaagctctgcttcggcgattaaaggagacccggaagccaaggtagacttccagattcattgcggcccggcattaggcgcctttaatcaatgggtgaaaggtacggagctggagtcctggaaaaaccgccatgccgatggtatcggccttcgtcttatggaagagacggcctcgcttttgaatcagaagttaggctcatttctgcaaacgtgttgacaagacgaaatgatagattgaaaacatggaatattcataaaagatgaaacagggaggaactgacaatgagtgaagaaagaatctttgaattgctgcagaacacaatctacgaggttttgcctgatttagaaggcgaacagctttcacaggaagaccggttagttgatctgggggcggactcagtggaccgcgccgaaattatcacgatgatgcttgaagaattatcactgcagatcccgcgtgttgagctgacgggagtgtcaaacatcggcgaattggcggcaaagctttatgaaaaggtacaggctgtctgataaaacggtgaaaaatcggaaactcaaaattcatattggaggcgaagttcatggcggctgccggaatagaagcgataaatgtgtttggcgggacggcataccttgatgtcatgcagctggcggagtacagaaacttagaccctgccagatttgagaatttactgatgaaagaaaaagcggtggcgcttccgtacgaagaccccgtcacattcggcgttaacgcggcaaagccgattatcgaccgattgacagaggctgaaaaagacagaatcgagctgctgattacctgctcggagtccggtattgacttcggaaaatcactcagtacatatattcatgattacttaggcctcaaccggaactgccgtttatttgaactgaagcaggcctgttattcaggaacggcgggtttgcagatggcgcttaactttattttgtcgcagacatcccccggagcgaaggcgcttgtcgtcgcaacggatatttcccggtttttaattgccgaaggcggcgatgcgttaagcgaggattggtcttacgccgaaccgagcgccggagcgggtgccgtcgccttattgatcggtgaaaatccaattgtatttcaggcggatgcgggcgccaacggctattacggctatgaggtgatggatacatgccgtccgatcccggacagtgaagccggtgacgccgacttgtcattgatgtcatacctcgattgctgtgaacagacatttcgcgagtacaaaaaccgtgtgccgggcgctgactacaaagagacgtttcactatctagccttccatacaccgtttggcggcatggtcaaaggggcccaccggacgatgatgcgcaagcttgcaaaagcgaaaaacgctgagatcgaacaggattttcaaaccagggtagagccggggctccgctactgccaaagagtcggaaacattatgggggcagcctctttactggctcttgcaagcacgattgaccaaggggcattcgacacttctaagcggatcggctgtttctcgtacggctccggatgctgttcagaattttacagcggcgttgtgacgcctgaaggacaaacgcggcagcattctttcaaaatagaagagcatctgaacaacagatacaggctgtccatggaagagtatgaagaactgtttaaaggcagcggtttggtgaagttcggaacccggaatgtcaaattggatatgaatatgattccgaacattttagaccatcatgccgggagccctcgtttatatttggaagaaatcacggaatttcatcggaaatacaggtggatcccgtgacctatgagacgatcaacgtccgttttcagcaaaatgtctgcttcatcacctttgatcggcctgaagccaacaatacgattaatgagcgtttagtggaggaatgcctgcacgttctttctgaatgtgaggactccgtgacctccgtagtgcttgaagggcagccggaggtattttgtttcggggcggattttgatgagatgtaccgaaaaatgaggcagggaatgcagcatgcggaatcgcaggagccgctttaccgtttgtggctggcattaaaatccgggccgtacatcacaatcgcccgcgtccgcggaaaagtaaatgcgggaggtgtcggttttgccgccgcgtgcgatatcgtcattgcagaggagagtgcttcgttcagtttatctgaactgttattcggactttatccagcctgcgttctgccgtttttaattcaaagaatcggatttcaaaaggcgcattatatgacgattatgacaaagcccgtgccggcgcgccaggcgcttgaatggggactttgtgacgtatgcgtcccggactcagcaacagagctgagaaagcatttgctgcgtcttcgcccgctgtcgaaaaaagcagtcatccgctataaaaaatacatggattccttaaacgaccttgttcatcgttcaaaatccattgctctagccgaaaatcaagcgatgttttcagatccggataaccaatcagccattttccgttatgcagaaacggggcggcttccttgggaaacggagaacagttaggaggatatcatgccgaacgccgcagttgaactgctcgaaattgaaccggatattatccaagtgacaatgcaggataaagcccataaaaacgctttctccaaagaactgacggatggattgatggaagcattcacccgtataaaaaaatcgtcagtctataaagctgtgattttaacaggatacggccattactttgcttccggaggcacacaggaaggtctgctcaggattcagcagggcatcacgaagtttacggaagaccgcatgtattctttggcgctggaatgtgatatccccgttatttcagccatgcagggccacggaatcggaggcgggtttgtcatggggcttttcagtgattttgtcattttaagcaaagaaagcgtgtataccgcaaactttatgaaatacggtttcacccccggaatgggggctacctttatcgttccggagaagcttggggcaagcctcggccatgaaatgctgttaaacggcggccactaccgcggcggtgacctggagaaaagaggagtgccttttccggtgcttccgcggcaggaagtattagactatgcgcaggaattggctcgtgagcttgcggaaaaaccgagaaactctttaattacattgaaaaggcacttggtgacgccgttccgcgagcagcttccggctgtcattgagaaggagttaatcatgcacgatgagacgtttcatgatgatgaagtgaaaaaacgaatcacgacgatgtacggagtataagacatacatcttacatacagatgaaatggaggcagctctatgaaaagtgatatgaaggcaagcgggttactcaagccatctgtcagctacggaaaaccattgcggctttcagcggatcagccgatgacgattcctgaagtcctgcacaaaaccgccgcgacagcgggagatcaaaagggcatcacatatatacagcctgacggcactaaagtgtaccagacttacagcggcctgaaaaagatcgctctttcgattgtgaaagggctccgccaatcaggagtgaaggctcaggatgaagtcatattacagctcagtgacaattcccagctgattcctgcgttttggggctgtgtttttttaggagcgatcccggttccgcttgcggccgctccggcttatacagaaatgaacagcgggacgcaaaaactgaaagacgcctggacgcttttgaatcagccgtatgtcatcacaagccgtgaagtgctgccggagatgactgaatgggcggaggagcaggagctttccgggttttgcgctttggcggcagaagatctcagtgcgcatgaaatggatacggactggcatcatccccgtccggaagatttggcgatgctgcttttgacctcgggaagcacgggcacgccgaaagccgtgatgctcagccatgaaaacatcgtctgcatggtcaaaggaaatattcagatgcagggctatacaagtgaggatgtcacgtttaactggatgccttttgaccatgtcggcggcatcggaatgcttcatctgcgtgatgtttatctcggatgtgaggaaatcaacataccgagcgaatccattttgatggatcctttaaaatggctcgacctgattgatcattaccgcgcttcggtcacgtgggccccaattttgcctttgggctgcttgccgatttcgcagaagagattcaaacacggaaatgggacttatcttccatgcgttacatgctgaacggcggggaggccgcggttgcgaaagtcggacgcagaattatggagcttttagagccgcacggtctgccggctaatgccatccgtcccgcatggggaatgtccgaaacgtcttcgggcgttattttctcagatgagtttacactggaaaacacgagtgacgacgatcgtttcgtcgagatcggtctgccgatcccggggtttaatatgagaattacggatgaccgcaatcaagtggtggaagaaggagaaatcggccgcttccaagtgtccggtctgactgtaacgagcggatattatgagcgcccggacttaaacgagagtgtctttacagaagacggctggtttgaaacgggagatctcggatttctgcgtgaaggccgcctgacgataacggggcgcacgaaagatgccatcattatcaacggtgtgaattattacagccacgccattgaatcagcggttgaggaattgccggaaattgaaacgtcatatacagcggcatgcgccgtccggccgaatcaaagcacgacagatgagctggcgattttctttgtgacatccattccgttggatgagaaccgcatgacgaagcttcttcatcacattcaccagcacgtgacacagagaatcggcgttacccctgattatctgcttccggtcgcaaaagaagacattcctaagacggcaatcgggaaaatccagcgcactcagctgaaacattcatttgaacaagggcaatttgattcattacataataacagacaagaaggcggcaattcagacacggcttctgcagagaaagaaattgaacgggattttatccgttttctgaaagaggaactttccatcgcggatgagcttgttgatccaaatacaccgtttcaaagtcttggcgtcaactccatcaagatgatgaaactcgccagatcaattgaaaaaacgtatcacatccggctgacggcaagagagctgcacaaaaacccgacgattggcgctttagcggcttatactgctgaaaaagcggcaaacatgtcagcggagcatcattcccaaaaagccgaaccgccggcagaacgggagagacggcaaacggcgccggcgctttcagaagtccaaaaagggctgtggacattgcagaaaatgtcgcctgaaacgactgcataccatgtcccgctctgtttccgattcacaaccggaatcgacaaagagaaactgaaacgggcgtttcagctcgtattaaagcagcatccgatgctcaaaagcgccgtgaatgaaacagacggcgggttttatttcatagaagcggcagatccttttgtattcttggaagaagatatttctgacgtcaatgaatcacaaatatccgctctgatacggaaaaaagtgaaagagccgtttgtcaaagaaggcgggcctttgctgcgtgtgcagctgctttcaaaatccgcctcggaacattatcttttgacggtcattcaccacatcgtgtttgacggtatttcatccattacatttattcacagtctgctggatcattatcaggcgctggtggagggaaaagaagagtttgcggccgccgctcccggcattcattccgatttcgcggcttgggaaaagcggtatttagcgggtgaagaaagcaaagctgcccgcgcttactggatgaaacagctcgggggcgatctgcctgaccttcagcttccgccgatgcgcgcggacagcagcgttccggagtttacagaagatacgctgacacgccgtcttcccgaacggctgctgaataatctaacggcgtttgccgcatcccgttcgattcatttgtctaccgttatgctgagctgctatatggtgcttttaagcaaatatacagataaggaagatattgtgacaggcatgcctgcaatggtcagacctgaagaacgctttgacggagtggtcggccatttcctcaacatgcttcctatacggagcagagccggacgaaaagaaacatttgctgactttgttcaaaaggtgcaggatgccgttctggacggactggatcactccttttatccgtttccgaaaatggtgcatgatgtgcatgcgaaaccccggcagaacggttcgcctgttttcagcaatgcctttttctatcagaactttctgcagcattcaagttatcaatcgatgctggatgaatacaaggaattctcctgtgagtttgtaaaagacattcatcaggagggggaatatgatcttgtatttgaaatgtgggaagaagcatcaggcatggatcttacgattaaatacagcaccgaattattcgacgaagcaggggcggccagacttttcagccaatttgtacaggccgccgaagctttgacggcgaatccggatatgccgcttgagaacgtttctctcatgacaaaaagagaggagcacatgattcttaagacttggaatgagacaagccgtgaatatccggatgcctgcttccatgaattatttgaacgtcaggcggcagaaacgccggacgcttgtgcggtcgtgtatgaacagcaaaagctgacgtaccgtgagcttgatgaaaaaagcacgaagctggcgctctatttgcaggcgcacggtgcaggccctgatgatctcatcggcatttatacagaccgttcattgcatatggctgtcggccttctcggcattttaaaagccgggggagcgtatgtgccgcttgatccttcttatcccgctgacagattggaatatatgatcgccgacagcaggatttcaatgtgtctgacgacagctgatttagagcactccttgaactggggaggcgtgcagacaactgccattgaccgcgattggtcttgtattgaaagcacagccgcggaaagaacgtcgctgaagcggttagtgacacctgacgatctggcgtatgtcatttacacgtcgggcagcacgggcaaaccgaaaggcgtgatgattccgcaccgggccctgaccaatttcttaatctcgatggcatatgaaccggggctttcgtctaaagacaaactgcttgccgtcacgacatattgctttgatatcgcggcactggagctgtaccttcctttaatcaaaggagcggagtgcaacatctgtaagacagaagtcacaaaagacgcacggaagctgaaagagctgattcaagagtacaaaccgacgatcatgcaggcgacgccgtttacgtggaaaatgctctttcattccggatggtcaaatgaagaaaaagtgaaaatcctttgcggcggagaggcgctcagcgaacaattgaagcagcagtttctcgatacgaaaagtgaggcttggaatatgttcgggccgacagagacgacaatctggtccgcggtgcagcgtataacggaaaatgagagcgcgcttacgatcgggcgcccgatcgccaatacccgtgtgtatattatggattccggtctcaaccctgttttagaaggggtgccgggagaactttgtattgcgggagacggattggcaagagggtatttcaacaagcctgagctgacagataaagttttcgtcagccaccggctcgaactgggatcaaagctttataaaacaggcgatatggcgcgttttcttcccggcggccgcattgaatacatgggacggatggacacccaagtcaaaatccgcggctaccggattgaacccggagatattgagagccggctgaatgcctatccggccgtacaggaaagcgtagtggttgtgaacaatcactccggaaatgaaaagctttgcgcattttatatcctgaaaaacggagagccgcttccgtctgcaaaggaattgcgcaatcatttgaaacaagcgctgccggcctatatgacgccagcttcgtttatccgtcttgaagagctgccgctcacaccgaacggaaaagttgaccgcaagcttcttgctgcccgtgatctgacggaaaagcagccggacacacaaacattttcatcatctcatatccagcaggcggtgctggcgatttggcaggatgtattgaaaagcaaagatatagagcttgatgaccgcttttttgatgcggggggagattcgcttcttgccgtgactgtcactgaccggatgacgcaggaactggattgtgaattcagtgtaacggagctgtttgaatacgcgacggtaaaagacatcagccggtacatcacagaacaaaaaccgaaagaagccgttttggctcctgtgccgcaaaagaaagtgaatacagaagaccgggaacacccagcgggagaaattcccgattattatgaggacagtgtcgcggttatcggtatatcctgtgagtttccgggagcgaaagatcattatgaattttggaataacatcaaagaaggcaaagaaagcatcaccttcttttcaaaagaggagctccgccgatccggtgtttctgaagaactggctgatcatcccggcttcgttccggctaaatcagttttagaggggaaagaaatgtttgatcccggtttcttcggcttttcgccgaaagatgcggaatatatggaccctcagctgagaatgcttttgctccattcatggaaggcaatcgaggatgcgggatatatctcaaaagaaattccggaaacaagcgtgtatatgtctgccagcgcgaactcttaccgcagcctgctgccggaggagacgacagcacagctggaaacgccggatggctacgtgtcatgggtgcttgcccaaagcggtacgattccgacgatgatttctcataaactcgggttgaaagggccgagctattttgtccatgccaactgctcatcttcgttaatcggcatgcattcggcttttcaaagcctgcagtccggcgaagccaagtatgcccttgtcggcggtgcgacccttcatacggaatcaagtgccggctatgttcatcagccggggctgaatttttcaagcgacgggcatattaaagcgtttgacgcggctgctgacggaatgattggcggtgaaggagccggcgccgtgctcttgaaaaaagcgtcggatgccgttaaggacggcgaccatatttatgcgctgctgcgcggaatcggcgtcaataacgacggagcggataaggtcggattttatgcgccgagcgtcaaaggacaggctgaggtcattcagaaggtcattgatcagacgggcatccatcctgaaacgatcgcgtacgtcgaagctcacggcacaggaacaaaactcggcgacccgatcgaactgtccgcacttcaatcggtgtacggccgatatacagataaaaaacaatactgcggcatcggttcagtcaaaacaaatctcgggcatttggatacagcggccggaatggcgggctgtatcaaggttgtcatgagcttatatcatcaggaaatcgcgccgagcatcaattacaaagagccgaacccgaatcttcatttagaagactctccgttttacgtagcgggagaaaagaaagagttaacccgtgagaacagagcgcaccgcatggctttaagctctttcggtcttggcggaacaaacacacacgcgatttttgaacaatatccggatgcatccgaagcagcagacgctgccggtccgttcatcattccgttgtctgccagaaaaaaagatcgtctgaaggagtacgcaaaacagctgctggcttttctggaaagaaaaacggccgccggcctcgctgatcttgcctacacgttccaagtcggaagggaagcgatggaagagcgcgcggcctttatcacaagcggcactgcggagctcaagcggcagcttgccgattttatcaatgataagccggctgtaacaggctgcttcagaggagaaaaacagcaggcgaaagatattgcctggctttctgatgatgatgacagtgctgaactcattgagaaatggcttgcgaaaggaaaagcaacgaagctctgtgaaatgtggagtaaaggtgtcgccatcaattggcacaagctttacaaagacaagcatccgaaacggatcagcgtgccggtctacccgtttgcaaaggagccgtactggccgaaaaaagcagaaaagaaaacatctgccgcatacaccggagtctcagttttacacccgctcgtgcagcaaaacacgtcagatttggccgttcagcggttcagctcacggtttacaggctcagaatttttcctgaaggatcatgtggtcagggaaaaagcggtactgccgggagcggcatatttggaaatgtcttatgaagcggtaaaacgggcgcttggcggcttattaaaagaccaagacagaataacgctccatcataccgtctggatgaaaccgatcgtcgttcacgaacaagagcgccaagtccatattgcgctgttccctgaagaggacggcatcatctcatatgacatttacagcgtaaacgctgacgatgaagaagtgctgcacagccaaggacgggccgaaatcataaaggctgaacgagagccagagaccgacctttctgccatacaaaacagatgcacagcggacattcttgatccggcggccttttatcgggaaggccggagcagggggatgttccacggaaaagccttccaaggcattaagtccgcctttatcggcgagaaagaagtgctttcggacatacagcttccggattctgtttctcatacgaacggacaatttacgcttcatccgagcatcattgattcggctattcagacggcgacgatctgcattatgcaggagttttccggacaaaagctgattctgccgtttgcgctggaatatcttgaagtcatcaaagcatgcacgccgactatgcgggcgcatgcgcgcttcagtgaaggatatcaaaccggtgattccgtgcagaaagccgacattgacctgttcgacgaaacaggagcgctttgcgtgaaggtgagaggattctctacgagagtgcttgaaggcgatgcagaatcggctcagcggccatcaggctcggaaaaggtcttgtttgcaccggtttggaaagaagccgccgcatccgagaaagcttctgtccatgctgatgagcatttgatcatactttgtgaagatgcctgccgtataaaagataaagcggcatccggcctgaaagacgccgaactgctgattgcagaaggtgagggtgaaacagccgctgaacgcttccaaagctttgcgcagacaatcgctgaacacatccggcggatcatcagcgaaaaaaggcagggccgcattctggttcagaccgttatttcagcagacggcagccagcaattgtttgcggggttaacaggtttgttaaaaacagcagagctggaatacggaaaacttgactgtcagctcatcgagatggaatcaatcggcgaaatgccggctgtcgctcaaaaactgaaaaacgacagtcatcggccgcatgataaacatatccgttatacaggagaaaaacggtatgtgaaggcttgggaagaaatgcatcctgcaggtggcggcgccgtctggaaggacgaaggcgtatatctgattaccggaggcgcaggaagcctggggttgatgttcgcaaaagaaatcgcaggtcgcgtaaaacacccgaaaatcattctgaccggccgctcaaatctgacagaagccaaacagcgtgagcttgctatacttcaggactcaggcgcaaatgtcgtctacaaaaagctgaatgcggcagaccggcgggaaaatgaagcgctgataaaagagattacggcggagttcggggagcttaacggaattattcacgcagcgggagtgattcaagaccgtttcctgctgcaaaaaacgaaggaagagttcagggaagtgcttgatccgaaagtgatcggcaccgcttatttagatgaagccagcaaagactgcaatcttgactttttcgtattgttctccagtgtttccggcgttctcggcaatgtcgggcaggctgattatgccgccggcaacgcgtttatggatgcatacgccgcttacaggcaatcccttacggagaatggcttgcggcacggaaaaacgatcgcctttaactggacgctgtggaaagatggcggtatgcaggcgggagacgagacggaaagaatgatgaaaaaagctttcggcatggttccgcttcaaaaggcgtcaggcctggccgcattttatgaaggaatggctcaggaaaagccgcagcttttagcagctgaaggagacgcagcaaaattaaaacagtcgttcctgtccgtttctgaaactgaaaagccgcaggtggagaaaatagagcctgtatccgccgtttcgggagacaaatggcacggtgcgcttatcagattggtcagttcaattttaaaagtcggccaagacgagattgatattgatacggaactgagtgaatacggttttgattccgtatcctttaccgtctttacgaatcaattaaatgaagcgtatcagctggagctggcgccgacgatcttcttcgagcacgggacgatccgcagtttagcagagtatttgacggatgaaacagaagcaggtcttccttttcagccggaagaaaaacacgatgcagaagaatctcttcaagcgcttcacaccgctttgacagccatggtaagcggcattttaaaagttgaccgtgaggacattgatacagatacggaactgagtgaatatggttttgattccgtatcctttaccgtctttacgaatcaattaaatgaagcgtatcagctggagctggcgccgacgatcttcttcgagcacgggacgatcagcaatctcgccggatatttggcaaaagagcatccgggccgtttcggcgaaaagaagaaggagtctccgaaaaaagagcagccaaaagcccaaaaaccgaaaatgcagcggaaaaagcgcttcgcaacggtaatgaacgctagggcagcgacacaagagccgcgccgcttggaccctgttgccattgtcggaatcagcggccgattcccgggcgcgaaggatatagaggaattttggcgcaatctgaaagaaggaaaagattctatcacaaccattccgaaagaacgctgggattggcaagcgtttgatggcgacccgaatcttgaaaggaacaaaacgaatatcaagtggggcggctttatcgacggaatagctgaatttgatccgctgttctttgggatttcaccgcgggaagcccaatatttagatccgcagcagcggctgttattgacttatgcatggcgggcgatagaagatgcgggctgtaagccggaaagcctttccggcacaaatacgggtgtctttatcggcaccggaaataccggttataaagatttgttcacaagggcaggacttgcgccggaaggacatgcggcgacaggcagcatgattccttccatcggtccgaaccgtttgagctatttgttaaatcttcacgggccgagcgagccgattgaaacggcatgttcaagctcgcttgttgcgattcaccgggcggtatccgctatagaaaacggagaatgcgacatggcgattgccgggggaatcaacacgattctgacggaagaagcgcatatcagctacagcaaagcaggcatgctcagcaaagacggaaaatgcaaaaccttctccaaagatgccaacgggtatgtcagaggagaaggcgcgggaattctgatgctgaagaaactgacaaatgcagaacgtgacggcaatccgatttacggcgtgatccgcggtacggctgaaaaccacggcggccgggcgaatacgttaacctcgccgaatccgaaactgcaggctgatttattggtgaaagcatatcggaaagcgggcgtggacccgagcaccgtcacgtatattgaagcgcacggtacaggaacggaattgggcgacccgattgaaataaacggtttgaaagcggcgtttcacgagctggcgaaaacaaatcaagagcccgaagtctccgatcaccgctgcggcatcggttcggtcaagagcaatatcggccatttagagcttgccgcgggagtatcaggcgtcatgaaagtgcttttgcaaatgaagcacaaaacgctggtgaaaagcctgcattgcgagacgatcaatccgtacattcagctcgatgacagtcctttctacatcgtgcgggagactcaggaatggacggcagcgaaagatagaaacggaaatgcgattccgcgccgggccggggtcagctcatttggcatcggcggggtcaacgcccatatcgtcattgaagagtatgttccgaaagcagccgcgcagcctgagcacagtccggaaaatccggcaatcatccttttgtccgccaaatcaaaagaaaaactgtttgaacaggcgcagcagctgcaaaaagcgatccgtcaaacgccgtatacagatcaagacttggcgggcgtcgcttatacgctgcaaaccggaagggacgaaatggaagagcgcctggccattcttgcagcgacgatggcggaattggaaacaaagctggaagcatttacgaaaaatgagaaaaacatcgcggggctgtataccggccagtctcaccgcaataaagatacgtttgccttattcacggcagatgaagatatggacatcgtcattgacgcctggattaaaaaaggaaaattcgccaagctggcagaggtatgggtgaaaggcggggtgttgaattggaaccggctttatgaaaaaggtacgccgcgtttactcagtcttccgtcttatccgttcgcaaaagacacgtattgggtgcctgagaatcctgacaaaaataaggtccatacagaggaacggatgaaacgtattctgacaaaacaatgggaactgagcccgctcgaactgcgtgaaccgtgcccacgttccattgcgattttgacaggcggggacacgatcaatctcgcagaagagatcgcagcgcatatgccgaatcaccgtatcatcacatcatcagaccttaccggtgaatatgactggcaggcgtttggcggagtcatcgacctcctcggcgcagcgaaagaagattctcaagacatggccggaatcaaatggcttcagcaattgattgagcatgggcataaagaagggatgacactgctttgtgtcacgaaagaccttgagtcattaaataaagaggccaatcaaacaacaggagcaaaacgggccggtctgtacagaatgctggcatgtgagtacggtcatctgtcttcaaggcatctcgaccttgaaggagcgctttctgatgacaaactggcgaagcagattgccgatgagtttcatgcccgtactgatgacgcggaagtttgccggagggacggcttgcgctaccgcgctgtattgagcgaatcagaaaatatgaatatgcaaggcgagagaattgattttccggacaaccatgtgcttctgatcaccggggggacgagggggatcggtcttttatgcgcacgtcattttgccgaacattacggagtgaaaaaactggtgcttacaggccgtgagacccttccgccgcgaagtgagtggacgggcggactgaatggggtgacggcttctgtaaaagcgaaaattgaagctgttctcgacttggaatccaaaggtgtacaagtgaaggtattgtcagtcccgttagctgatgaagccgggctgagacaggaactgagtcagatcaaacagacgctcggacctatcggcggcgtgattcactgtgcgggtgtgaccgataaagagacgctcgcattcatcagaaaaaccgatgaagacatacagcgcgtgctcgagccgaaagtagacgggcttcaggcattatacagtgtgctcagcgaagagccgctgaagtttttcgtcttgttctcttccgtgtcagctgcgataccggcgctttcggcaggacaagccgactatgccatggccaatgcgtatatggactattttgcagactcatacaaagagcagctgccgatcgtaagcattcagtggccgaactggaaagaaaccggaatgggcgaagtcacgaacaaagcttataaagagagcgggctatacagcatcacgaatgcagaaggattacagctccttgacggcatacttcttgcatcagcaagaggcccggtgctgccggccgttctgaatcctaagctgtggaagccggagcgattcctgcggcgaagcaggcaggatcagccaatgagcccggctatggtaaaaccggcggaaaaaaccgctgatactgccgcagacaacgctcaattaacaaggaaaacagaagaatggctgaaagaattattttctgaagagctgcggattgaccaggatcagcttgagacagacgtattattccaagattacggagtggactccattatccttgctcagcttctgcagcggatcaatcggaatctctcggcatcgcttgacccgtccattctgtatgaatatccgacgattcaatctttcgcaaattggcttctcgaaggatatacagaagttttgtcagaacggtttgatttggcggcggagcctgttatgaagaagccggctgagccggtaattgtaacacaagccgttaaggtgcaagaagagccggccgaaaaacagattcaccgggaagatatcgcggtcgtcggcatgtcctgccggtttccgggggcggcttccttagaggcgtactggtcgcttttggctgaaggccgttcggctatcggtcctgttccggctgagcgatgggggttgaagacgccttattacgcgggaatgcttgatggaattgatcaatttgatccggacttctttttactggctgaagaagatgtaaaggcaatggaccctcaagctttggccgctctggaagaatgtcttaacctgtggtatcacgcgggctatacgccggatgagataaagggagaagcaataggtgtgtatctcggcggacgcagccgtcacagaccgggtgaagagaaactgctggatgcgaaaaacccgatcgtcgcgctgggccagaattatttggccgcaaatctctctcaatattttgatatgcgcggcccgagtgttgtcctcgatacggcttgttcttctgctttagtcggaatgaatatggccgtgcaggctcttctaacaggagaaataaaagcggccgtcgtcggcggtgtgagcctgtttgaatcagaagaaacccataaattatttgaacagcgcggcatattaagtaaagcgcagtcgttccatgtatttgacgaacgcgccgatggagtcgtgctgggcgagggagtcggaatggttcttttaaaaaccgtgtctcaggccattgaagacggagattctatttatgccgtagtgaaggcggcatccgtcaataatgacggaagaacggcaggcccggctacgccgagcctggaagcgcaaaaatccgtcatgaagacggctcttgaaaaaagcggaaaacagccggaagacattactcatattgaagcgaacggttcaggcacggtcgtgacggatctgttagaactgaaggccattcaatccgtctaccgttcaaaagatgccggcccgctcggaatcggatctgtgaaaccgaacatcgggcacccgctttgcgcggaaggaattgcaagtttcataaaggttgttctcatgctgaaagaaaagagctttatcccgtttttatcaggtgagcatgaaaacacacattttgatagagaaaaggccaatattcagttcagccgcactctggcagactggccgtcaccaataccggcggcaggaattaactgctttgccgacggcggaacaaacgcccacgtcattgtggaagcgtggcaggaagacgaagggcgccgaatcaagcgccaccctttaacaccgcctgcattaaataagcggctgatttcgccggacagcaaagaagaaacgaacgaaaaagctgcggcaaacatctgggatacctatgaagtggaggtttaacgtgaagaacttcaataagcaaatcactttatcgctgaaaaatccgtttattttacatcatgacgtttacggacaaaaagtccttccgggattggcttatattgatatgttttatcagattttcaaagagcgcggctattcatacgacgggcttcagctgcgccatttatccatatatcagccgcttatcgcgaaagaagacagcgccgtcaagcttacggttgaatgtacaaaggtaaaagaagggcgctggaaacttaccgcaaaaggggctgaggtcagcggcggacgagtccagccggaagaacgtatttacgtcaaagcggaaatgcacgagacggcacccgcagttttcagtgacacgcttgatcttgactctgtcaaacgcgaggcggagcgcaccatcgatttaaatgagctgtatgcacaatgcagaagccaggaattggttcacagcggatatatgaaagcagaaggagaagtgtttgaggagcgggacggcgttacctttgatgtatcgctcggaaaagacgcgatgggacaggccggagggtttttgttccatccgactcttcttgacggaagcggcgtcggcgcaaacctattgatctcctcgctgttaaatggggaaaagaggctgtttctgcctcttttctacgaatcttttacagcttccgaacctttgcaggccggctgcatcacgagaatcaaacgttcgtcgcttcggcaggaaaaagagctcatttacattacactggagttttttaacacatccggccgaaaagtagccgagctgaaagatttcacaagcaagctcgtgcgggatgccgagctgatcaatacagaccgaaagactgctgagaagtctcctgaaaaagccggtttaccggaagttgcggcatcgcttgaaggcggacacccgcatgaggaagcagaacggtatgtcatgaatctgatggctgaaaaaatcggcaagccgcttgaacagattgattctcaagtcggctactatgaaatggggctgacatcgtccggactgcttgacgtcgtcgaaacgataagcgaaaaaatcggcgaaaccctttctccgactttgctgtttgaatatacgacggtagcagagctggcggctttcctgacagagcagtacggaagccatttcagcgcgtctcctgcaaaaatagagaagcaggttgagaagcaaacagaaagaagacggaaaagcagtgttccgcaagatgaagatatcgcgattatcggcatggccggccgctatccgcaggccgaaaatattcatgaattctgggaaaacctgaaagaaggaaaaaactgtgtcaccgaaattccggagtctcgctgggactggcgccggtttgaaaatgtaaagtcgccttccggaaagagcatttcaaaatggggcggatttattgatgatccggattgctttgatccccaatttttccggattacgccgcgggaagctgaaacaatggaccctcaggaacggctgtttttacaaacatgctgggaaacgattgaggatgccggatatacgccgaagtcgctcgcagaggcgcgcggacggaataagagacagcgcgtcggcgtcttcgcaggggtgatgcataaggattatacgttggtcggggctgaagcttcttctgaagatcatgtattcccgctttctcttaattatgcgcaaatcgcaaacagagtttcatatttttgcaattttcacgggccgagcatggcggtcgatacggtctgttcatcctcgctgactgcggttcaccttgctgcggaaagcattcggcgcggggaatgtgaatcggcggttgccggaggcgtcaacttgtcgctgcatccgaataaatatctgacatacggtttatgggacatgttttcaacagacggggtttgtcatacattcgggaaagacggagacggctatgtaccggctgaaggaatcggtgccgttttattaaaaccgctgcgagaggcggtaaaagacggagaccggatttatgcggtgataaagggcagtgccgtcaaccacgtggggacagtgagcggaatttccgtgccgagtcctgtcgcgcaggccgatttgattgaagaatgcctggacaaagcgggcatcggtccgcgcacggtcagttatgttgaggcgcacgggacgggaacttctctcggcgacccgatcgaggttcaaggccttgtcaaggcgttccgccagtacacacaggacaaacagttctgttcgatcggatcagtgaagtccaatatcggccatgcggaatcggcggcgggcatcagcggcttaagcaaagttgccctgcagcttcaccataaaactctggtgccgtctcttcattccgaggagctgaatccgtatttagattttgaacaatcaccgttttacgtccagcatcataccgaagcatggcagcagccctcagtaaaggaaaacggaaatgagaccgtatatccccggcgtgcaggcatcagttcttttggggcgacaggttcaaacgtgcatctcattctggaggaatttgtccctgaagaatcacacggaacagtggctgaaccggcagaagaacagacattcattttcccggtttcagcccgaaatgaagaacggctaaaagagtatgttgcgaagctgtctgcatttattcatcccggcctgccgcttgaggatgcggcgtatacacttcagatcggccgtgaacagatggaggagcgggttgcgttcaccgctcagaatatgacacagctcaaagagaggctggaaggctttctggcgggtaaaacggtcagcggatgctggcggaaccgagccgataaaagcaaacaggcagagcttgctccggacttgatacataattggctttcttccgggagtctggagatgattgccgaaaagtgggccggcggaggaacgatggattggaatctcttgtacagtgaaaacaaaccgaatcggatcagcctgccgacatatccatttgaaaaaatccggtattgggtgccaaaggcggagaaaagagaatcgctgccgcaaaacagggcaggcatgctgcatccgctccttcatgaaaatgtatcaaacatgtcaggtgttcgtttccggtcctcttttagcggcggagaatttttcctgaaagatcacgtcgtcaaaaacgagcggacgttaccgggcgcggcttatctggaaatggtccgggcggccgttgaacacgcggcagaaacgaaggaagaaggaacagtccgtctgaaacatgttgtatggatacgtccgtttacagcggcggatgaatccgcagaactgtatctccgcctttatgacgaagaaaatggggagatgggcttcacggtttacagtgaatcggcttccgcggaacaagagcccgttctctatgcgcaaggaagcgcggcgtgtgtcggagcgggcgaaccggctaaaatcgagattgacaaattaagagagtcacgccgtctgatcacacctgacgcttgctatcaggcatataaacagatggggattgaatacggggatgctcacaaagcggtcacggaaatctatgcaaaagacagcaaagtgctcgcgaagctctcactcccgtcatctatttctcatacaaaagatcagtttgtcctccatccgagccttttggatgcggccttccacgcgacaatcgggttaatgcttgacagagacgggactgacataaggccgatgctgccgtttgctctcgaacagattgatgtgttgaaaagctgtaaaagcgatatgtgggtttccattgcgtacagcggcgaaagcaagcctgaagatgccgtgcagaagctggatattgatgtatgtgacgaacaaggcaatgtatgtgtgaaaatgactggttattccgcacgggaaattgaaacggataaaacagatacactattttttgaacacgtatgggaagagaaggccgctgtacatgaaaaagcgccgactcatttcaaagcccgtcacgtgatgatatcagaccggtttacggatcaaatgaacagcatacagacagacttcagctgtcacgtgctccgtgatcagcataagagtgaagacgaacggtttgaagcttgtgcgcttcaggctttcgaagaagtgaagaaaattctcgcttcaaattccggcgggcgcgagctcattcagattgtcgtgcctcaagaagcggatacgcagctcctttgcggcttaacggggcttttgaaaacagcggcgcttgaaaacccgaacctgaccggccagctgattgaattggagccggacgtcaaagcagacacgctgtcccgatatgtaaaagaatgcagcgctcatcctgatgacaagcatattcgctatgaaaacggcaagcgctatacggcacaatggcaggaaacagggcttgaacagttcggcgccgaaaagccgtggaaggataaaggtgtttatctgatcacaggcggtgcgggcggactcggatttttattcgccaaagaaatcgcccggcatgcaaaagacgccgttcttattttaacggggcgttctctgttggataaccgtaaaaaagtccagcttcaagaactgtccgatctcggcgcgcaagccgtgtacaaacaaacggacatgacggaaaaacaagaagttcaatcgctcacagcggacatctgccggaagtacggcggattaaacggtatcatacacagcgcgggaacgataaaagacaactatattctgaaaaagcacaaagatgaaatccgtgatgtactggcgccgaaagtctccgggctggttcatcttgatgaagcggcaaaggacattgagcttgattttctgattcttttctcttccggagccggaagcgccggaagcgcgggccaggctgattatgcgatggccaatgcgtttatgaacgccttcagtgaaaaaagaaaccgtaaaaaagcccgaaatgaacgctatggacacaccctttcaatctgctggccgctttggaaagacggcggcatgacggttgatgctgaaacggaagcgatgctgacaaaagaaagcggcatggtccctatgaaaacagaaaacggcatccatgctttgtaccgcgggtgggcggcaaacacatcccaaatcatggtgacggaaggctacgccgcaaaaatccgggcgtttctgaaaaaatcagcggatgatcagccggataagggcagcaaaacggaagaaacggcaggtcttacagcaggcggagagaacatgcttgcagaaaaaacagagcatttcttgaaacatgtgctttcggaagtaaccaaacttcctgtcggcaaaattgacgccaaggcgcctatggaagattacggaattgattcgattatgattatgcatttgacgggccggctggaaaagagcttcggttcattgtcaaaaacattgttcttcgagtaccagaatatcgaatcgctggcgcagtattttatgaaagcacaccgggacacgctgcgggaagtgaccgggatgaaaacagaagaaacccctgcagccaaaccggcgctgtctgagaaagcgaaagtaaagcccgtttccaaacggaatgaaggcaaaaaaggctttgcgcaagtccgtccagacgcgcggaaaaatcagcagctgacggagcgtgaagatatcgcgattatcggtatatcaggacgatatccgcaggccgaaaatcttcaggaattttggaagaacttgagtgaaggcactgactgcataaccgaaattccaaacgatcgctgggatcacagtctttattacgacgctgataaagataaagaaggcaagacgtacggaaaatggggaggatttttgaaagacgtggacaaatttgatccgcaattcttctctatttcgcctcgggatgcaaaattgatggacccgcaggagcggttattcctgcaatgtgtctacgaaacgatggaagatgccggttacacgcgcaaaaagctcacggaaaaatcgggtgatttgcttggcgccaatgtcggtgtttacgtaggcgtcatgtatgaggaatatcagctttacggagccgaagaacaggcgcgcggaaaatcgcttgcgctgaccggaaatccgtcatcaattgcgaacagggcttcctatgtattcggttttaacggtccgagcatggcgctggatacgatgtgctcttcttctttaacagccattcatctggcatgccaaagcttgcggaacggggaatgcgagacagcatttgccgggggcgtcaatgtatccgttcatccgaataaatatttgatgctcggccagaacagatttttatcaagcaaaggcagatgtgaaagtttcggtgaaggcggggacggttatgtgcccggtgaaggagtgggagccgtgctccttaagccgctttctaaagcgaaagcggacggtgatcatatttacggcctgatcaaaggaacggccgtaaaccatgatggaaaaacaaacgggtattccgtaccgaatccgaacgcccaagccgcggtgatcaaacaggcgttaaaagacgcgggaaccgatccgagggcggtcagctacattgaagcccacggcaccgggacttcactcggtgatccgattgaaatcacgggtctgacaaaagccttttcagaacaaacacaagataaacagttttgtgccatcggctcagcaaaatccaatatcgggcactgtgaaagcgcggcgggcatcgcgggtctgacgaaggtgctcctgcaaatgaaacataagaagctcgcaccgtcactgcattcccggacgcttaacccgaatattgattttctctctacgccgttcaaagtgcagcagacgcttgaagagtggaaaagaccggtcataaatgaaaacggagtaaataaagaactgccgagaaccgcagggctttcctcattcggagccggcggcgtcaacgctcatatcgtcatcgaagaatataccgctgatgaggataaggagacggcttttgctgcacctcatccgtcgatgatcgtcctttccgcgaaaaatgagcaacggcttcaaaaacgggcggaacgtcttcttgatgcgctgcggagcgggcgttaccgggaagcggatctgagccggatcgcatatacgcttcaaatcggacgtgaaccgatggaagagcgtctcggaatgattgtcagcaatttgcgcgagcttgaagaaaagcttgacgaatttacgggcggcaaggagtcaattgaccggctctaccgcggacaagtcaaacagaataaagacacgatggcgctgtttgcggctgatgaggacatggaaaaaaccattgaggcatggcttgaaaaaggcaaagccgcaaaggtattagagctttgggtgaagggccttccgctgaattgggataagctgtatcaaatgggcagaccgcaaaaaatcagtctcccggcctacccgtttgcaaaagaccgttattggatcgacacatcagctgatacagctgtcaaaagaccggccgaaacacagtctgcgccgatcgcaccggcggccgtcccggaaccggtcattgaagtaacaactcttcacgaggagactgccaaagaaaaaccgtcaaacatttcattgcagcctttgagcggcgcgaaaccgaaaagaaccgtacagtctgcttcccgtccggcggtttccgctgaaaaagtaagtgccgaattaacggaaaggttggcggacgttttatatatggatgccgacgatatcgacgcagatgacacatttattgatatcggcatggattcaatcacaggtcttgaatggataaaggccgttaataaagcgtacggcacgtcccttacggtgacgaaagtatatgattatccgacaatccgccagtttgcggccttcttgcaaaaagagctcgggacagaaccgatccttgaggaagcagccgaaccgcagaaaacagaggccgtaaaaaaaccgtcaaacatactgctgcagcctttaaacgctcataagcagcatgtgatacaagcagaagcggatattctggaggcgatgtctgaaacagcagcttccgccgaaccggaagaaccgattgaagcggtgcatgacgagttatcaaaagcactggctgatgtattgtacatggagcggcatgaagtggatattgatgaggcctttattgacctcggtatggattcgattaccggtcttgaatggataaaggccgtcaataaacggtatggcacggactgtaatgtaacgaaagtgtatgattatccgacaatccgtcaatttgccgattttctgcgcacgcagccgtccgtccgcggaagaaaaaaacaggcggttcccgtacatccaaagccgcttacgcagcaagccgccccgcgggagaaaacacctgccgagccggagagattaacggttcaaaaggaacctgaaccggtgcaggccaaacgggagcctaaagacgagatagcggacgcgatagccatcgtcggcatgtcgggcaagtacccggatgcgccggacctaaagacatattgggacaacttagcccgtgcgaaaaacgccattcgcgacatcccgctttcccgctgggatgtaaacaaatactatgatccggccttaaacaagaagggcaaagtatactgcagatcaatcggtatgcttgacggcattgaagagtttgatccgctgttctttaatatatctccgtctgaagcggaacttatggacccgcagcaccggatatttttacaggaaggttttaaagcctttgaagatgcgggttacagctcaaaagaattaaacggaaaaaattgcggcgtttatttggggattatgaacaatgaatacggcatgatgttaaacaaacatcagacaggaggaagcgcgacgggcaacagtttcagcatcgcggcggcccgcctgccttattatctcaatttgaaagggccggccattccgattgatacggcatgctcttcatctctcgtcgggactcatttggcgcgtcaggcgctgttgaatcatgaaattgacatggcgcttgtcggcggggtgaccttgtatttaacgcctgaatcatacatcagcatgtgtgaagccggaatgctgtctcctgacggccaatgtaaagcatttgataacagtgcgaacggatttgtgcctggcgaaggcgcgggggcgctcgttttgaagaggctgaaagatgcggaagccgaccaagaccatatttacggagtcattatcggatctggaattaaccaggacggaaaaaccaacggcattaccgcaccaagcgcgaaaagccaaatggaattagagcgtcaagtgtatgaagcgcacaacatacaccctgagagcatcacctatgcggaaatgcacggcaccggcacaaagcagggggacccgattgaattagaagccttatcttctgtattcaaggaaaaaacggaccgcaaacaattttgcgccatcggttcggttaaatcgaatatcgggcatacgtcggcggcggcaggtgtagcaagcgtccagaaggttctgctgtcgatgaaacatcagcagcttgtgccgacccttcatttcagcacgccgaatgaacattttgatttcgatgactcgcctttatttgtcaataccgaacttaaaccttgggaaacaggcggagcaccgcggcgggcctgtgtcagctcattcggctacagcggcacaaacgctcatctcgttatcgaagagtatcagccgaaagaccggggaagccgtaagtctgatgagacaaacatttttgtgctgtcggcgaaaaaagcgccgcaggtaaaaacctatgccgagtctgtgatccaatttgcaaaagccaatcagaatatcaatctttcagatatggcatacacgcttcagaccgggcgtgatgcgatggattaccgtcttgcggttacagccggttcgagagaagaactgatcagccgtttaaccgattttgtaaacggaaatacgggtgaagggatatatgaagcccacatcaaaacggcaaaaaaagaaatcaaagcatttgaaacggacgatgatctgaagcagcttgtcaggtcgtggttcgataagaaaaaatacgccaaaatagcggaattgtgggccaaagggcttcagatggactgggacagactctatcaagacgaaaaaccccgcagaatcagtctgccggcttacccgtttgcgaaggagccttactggctgcctgaaccgaaagccgtaccgcaggaaacagaagaccggcgcgaggctgtgcttttagaaaagcaatgggttccgtgtgagatcgattcggccggtgagaaaagcggcaggacggtcatgattctggctgatgcagggacagcggggcttgccgaagagactgcaaagcatttcgctgactcgttcattttcccggccgattccgctgacactgcagctagcgattggaatcacatagatggcgcaatcgatctgacgggatgcggagacgaagacctttcactggaaggaatcagccggatccagactctgattgatacaagccgccggcaagcgcggccgctgacgctgctatatgtaacaaaaggcttggagccatttcagcagaaaacgattcatcttgcaggagcggcaaaaagcggcctgtacagaatgcttcaaaatgagtatcaaaacgtgacgtccagacacatggatgccgatacagatacggatcagcagacgcttgccaaacagattgcagatgaattttcggcggacagcacagaaccggaagtctgccgccgaaacggacagagataccgtgctttgttcagcgagattccaagcgggaagcgagcagaacataagcccgcaccgtttcctgaagaccatgtgcttttcattaccggaggcacgaggggactgggtctcttatgcgcccgccatttcacagaaaaacacggcgtgaaaaaagtagtgctgacaggcagggagccgattcctccccgtcatgaacggtcagccgttaatacgaggctgaaagagaagatacgggcgattgaagagcttgaagcaaaaggagtgcaagtggcggtgatcagtctgaaattgtctgatcatgatgcggcagcagcggaaattgaaacgatccggcgcacgatgggaccgatcggcggcgtcattcactgtgcgggatcggttaattcagtaaatccggcatttatcagaaagactgccgacgatatacaagaagtgctggaaccgaaagtcgccgggcttcaaacattaagcagccttttcacaaatgatcctttgcaattttttgtcttattttcttcagtatctgcagtcgttccggcgctcgcggcgggacagtcggattatgcgatggcaaatgcgtacatggattatttcgcggcggctcatcagcatcaatatccgttagtcagcattcaatggccgaactggaaggaaaccggattgggtgaagtccgcacagaaagcctgaagcagaccgggctgctgggactgtccaacgcggaaggacttgacttgctggaccgcattttatctgaaaacatccgtccgtccgttctgccggctatggttgatcggagcgaatggcatcctgacaggctgctctgtcaaaagaaaaaacaaaaagagactgaagccgtaataaacggcaaagccgcggaaaaacattcagacagagaactgcttcttgatacgaaggtgtggcttgtgaaactgttttccgatgagctgaaaatcgctccggaagaactggaaacagacgaaccgtttcaggattacggggttgattcgatcattttagcgcagcttttacagcaaatgaatcatgcgctcaaagaggacttagatccgtctgttttatatgaacacccgacgattgacgcgtttgccgaatggcttgtatccaatggtcaacagctgcttgcagaacgggaggaacctgatacagaaatgttggttccggctgccgtacaaacggttcacactgagcaaaagcgtgctgctgtaactgaagacattgccgtcgtcggaatgagctgccgttttccgggagcggaatcgttagaacaatattgggatttgctgagaagcggcaggtccgcaatcggctccgtcccggcggaacgtttcggatatgcaaatcaatacgttgcgggattgattgacaatatggatcactttgattccgaattctttttcattccggaaaacgacgcgaaagcgatggaccctcaggcgttggcggtgctggaagagagcttgaaactttggtgccatgccggctatacccgtgaagaaatcaagggcatagaagccggtgtgtatatcggaggccgcagccagcatcagcctgatcctgaaagtcttgcgaatacccgcaacccgattgttgcgggcgggcagaattatttagcggcaaacgtttcgcaattttttgatctgcgcgggccgagtatcgtgcttgatacggcttgttcatcggctttgacaggaatgaacatggccgttcaggcactgagaagcggcgatatcaaagcggcggtagttggcggcgtcagcctgctgaacacggatgcggcgcaccggatgttccaagagcgcgggctgttaaacgaaaaaccggcatttcacgtatttgacaagcgttccggcggagtggtcctcggtgaaggcgtcggcatggtgctgttaaaaacagtaagacaggcgcaaaaagacggcgacacgatacacgcggtcattaaggctgccgccatgaacaatgacggcagaacggcaggcccgtcagccccgaatatgcaggcgcaaaaagatgtcatgcaaagcgcgcttttcaaaagcggcaaaaagccggaagacatcagttatatcgaagcaaacggatcgggttccgcggtgactgatttgcttgagctgaaggcgattcaatccgtataccgctcaggtccgcatgttccgctcggcatcgggtcaatcaagccgaacatcgggcatccgctttgcgcggaaggcatcgcaagcttcattaaagtcgtattaatgctgaagcataaacaaacggttccgtttctctcaggagacgaaccgatgccgcattttgatataacaaagacagattttcactttcataaaacagccggcgaatgggatgcagccagaccgtcagcagccatcaactgctttgccgacggcggaacgaacgcccacgtcattctggaagcttgggaagaaaaagatacccgaatgaaaagaaagccgctgccggtaccgtcattaagacgtaaggctctggtaaaagaacctgacgtacgagcggagaaacaagagcttcctgcgaaaaaaatgttttggaaagcatttaaataagagaggagtgggaaggaatgatatcggaaaaaatcaatatctcactggatcatcccatcatgaagggccatatggtctttggtgaagcggtattgcccggtcttgcttatatcgatttgatttatcaggtttttcaggaacacggttatgtatacaatgagctcgaattgaagcatgttacgatttatcagcctttaaccgtcagtgaaacggctgcaatcattctgaccattcaatgttctgatagcggagatggaaagtggctcatctccctttcagggcagaaacagcaaggtgacgagctgtcagacaatatacaatatgcgacggctgaaatggtgaaaagagacgctgtcacatttgacgaaaccattgatttcggcgatgtgaagcagtcagccaggtctctgaatcttgatgacatgtataaccgctgtctggatcatgacttggttcattccggtatgatgaaatcgaacggacgattgtacgaaacagaaggcggcatgctggctgagctttcttgcgaagaaggaaaagatttctttttattccatccggcccttttggatgcgagcgggatcggggggagcggtttgctttcagaaacaaaccggcttcacctgcctttatattatgaatcgttcacggccgctgacaggcttcaatcagaatgcacggcgcgtatcgccgcttccggcgtccgtcaggaaaaagaactcacaacgatgacgatcgagtacttcagccgatccggacaaaaggtggcggagcttaaaaacattacgggaaaagcggttcggctcgaagaagacgcgaatacagccgaacagaatcaacaggctgcaactgagccggaaagcgcagatgaaaaagacatcattctgtttttaaagaagcttttggctgataagcttgggcagccttgggagacgctggacgttcttgcaggctactacgagcttgggctggattcatcttctttgcttgagattgtacaggatatcagtaaaaagacgggtgcggacctcgcgcccactcttctctttgaatatacaaatataaaagaactcgcagtctttctgaaaaagactggttcatttgaatgtgcggaggaacgtgcagccgaaccatcacggtctgaagctgaggcgccggacgcgccagaacttcataaaaacaccggagacatcgcgattatcggaatggccggccgctatccgaaagcgaaaagtgtggcggagttttgggaaaaccttaaggcgggcacggattgcatcactgaagttccgaagtcccgatgggattggaaaacatatcaaaacgtaacgtccccgtctggaaaaacagtatcaaaatggggcggtttcattgacgatgccgactgtttcgatccgcagtttttcagaatctcaccgcgtgaggcggaaacgatggatccgcaggagcgcctgtttttagaaacatgctgggaaacgattgaagatgcggggtatacgcctgaaacgctgggaaataaaggggagaaacagcatccgatcggcgtatttgcaggggtgatgcataaagattattccttaatcggcgcagaacaattatctgaaactgatccttttccggtttcactgaattatgcgcagatcgccaacagagtgtcctattattgtgacttccacgggccgagcatcgcggtggataccgtttgttcatcatcattgaccgccgtccatctggccattgaaagcatccgccgcggcgaatgtgaagccgcgcttgcgggaggggtgaacttgtcgctgcacccggcgaaatatctcagctacggaagcgtgggcatgcactcaagtgacggccgctgccgtacattcggcgagggcggggacggctacgtttccggagaaggagtcggtgcggtcttgctcaagccgctggaaaaagccgaacgagacggcgaccgcatttacgcggtcattaaaggaagcgccgttaaccacgtcgggaaagtaagcggaattaccgtcccgagtcctgctgcacaggcagaagtcattaaggcctgtctgaaaaaagcaggtatcagcccgcggaccgtcagttatgtggaagcccacggcacgggtacttcgttaggagacccgattgaaattgaaggtctgtcaaaagcgttcagccaagggacgcaggatcagcaattttgttccatcggttcggtcaaatcaaatatcggtcacgcagaatcagcggcgggaatcagcgggttaacaaaagcggcgctgcagcttcatcacaaaacgcttgtcaaatcactgcattctgcggaattaaatccttacctgaaatttgagggatctcctttttacgtacagcagcagactgctccgtggatgcagccggcagccgaagaaaacggaaaagtcacacattatccgcgccgggccggactcagttccttcggtgcatcaggttcgaacgcccacatcattttagaagaatacattcagcctgaacaaaaagcgcctgcacctgagaacgatgcagcaaaactcatcccgctgtcagcaagaaataaagacaggcttctggcctatgcggaaaaattagcccgatcgctttcagaaaagacggtgctgtctgaactggcttatacacttcagacaggacgtgaagcaatggaggagagagctgtcttccttgtaaatgacacccgcgacttgaaagaaaagctgaatgatttcgtaaaaggaaacgaaaacatccccggtctttggcgcggacaagccgagctgccggaactgagcgaaaccgctccagagacggatgatccgatacggcttgccgagttatgggcagaagggaaaataatagattggaataggctgtacgcttcgggtaaaccgcgtaaaacaagcgttccgacgtatccgtttgcaaaagaacgctattggattccgcagcagaaaaaacaggagaaaagcgtgtcaggcacagtgctgcatccgcttttacaagaaaatacgtcagatttttcgcatcagcgcttcacgtctctttttactggagatgaatttttcctatctgaccatgtcgtcaacggacaaaaaatactgccgggtgtcgcctatttggaaatggccagagaggcggtcaaaaaggccgctgccgtgacggaaaaaggccatagcgtcacactcaggcaggttgtttgggtcaggccggtcatgattgaagacaaaccgaaggaaatacatattgccctttatccagaagataatggtgagattacctatgaaatattcagtgaaacagaaaacggcgaagatccggttattcacagccagggtgaagcggtcattaccgaaccgggaagcgcccagattgatatcgagtctgtcaaagcttcctgcaattcagggaccgtgactgcggaagaatgttacggtgcttttgagaagatcggtctggattacggagaggcatacagaggcgtacagcaattgctgatcggagaacaccgattattggcccgtatttcactcccggctgccgtacatgacaataaagaacagtatacgcttcacccgagtatgatggacgccgcttttcacgcctccgtcggtctgcttgtccgctcaatacatgacgatgcagacagccacgagctttctctgccgtttgcaatgcaggaagtggaagtgttcgggccgtgtcctgaacatatctggtcatatatccggtacacagaaggcagcaaagcagatgacaacgtaagaaaatttgacattgatatgtgcgatgatgccggtacggtttatgtccggatgaaaggcgcgtccgtccgggcgcttgacacaggccaaacagcaggcggtgaaaccccggaggcgcctgtcggccatacgatgctgattccggcttgggagcccgttgcacttaaaaaaacgaagaaagcaaaaacggcggaaaagcagactgcggttttcggtgaaactgacagaatgcatacgcgcataaaagaacatctgccgaacgcttcctattatccgatcagaggtacggatgatatcacatctcttacgcacatgcttgaaggacaaaaagaactggagcaaatcatttggcttgctccgcaggctgagagtgctgacagcctcaaggaacaggaaagaaacgttcttcatgtgttcaagctgatgaaagcattacttgccttggggtacggagaaaaacatttggactggtgcatcgtcacagcaaatgcccagccgttttccgatcaagacagcgccgacccgtcacaagccgcagtcagcggacttgccggaacaatggcgaaagaatatccgcattggaatatccgcatgattgacacggaaacggacggcagctggccgatcgaagaggcgctcagtctttctgccggaaaaaacggtcaaatttgggcgtaccgcaatcagcagctgtttgagcggcagctgataccgcttgacaatatgccgaaaaacggcacgctgtaccaaacaggcggagtttatgccgtgatcggaggcgccggatatcttggcgaggcatggagtgaatacatgatccgccgctacaaagcacgcatcatttggatcggaagaagcacactgaatgattccatacaggcgaaactcgaccggctcagcgcattcggcccggcgcctgaatatgtttccgccgatgccgctgacagtgcttccttagagcgggcttatcagtttataaaagagcgtcacacaaaaatgaacggaatcatccactcggcaatggatctgtctgagcaaagcttaaataatatgaagacagaagagttcaaatcggtgctgcgggcaaaagccgatgtcagtgtgtccttggcggaggtatttggacaggagccgcttgactttgcgctcttcttctcctcgcttgtggcatttatccataacgtgaaacaaagccactatgccgcaggatgcgctttcagtgacgcatttgcgaaagaacttgatcagacgtggaattgtccggtcaaagtcatgaattggggctattggggcaacagcgaagcggctgaagacggcgattttattcagctgatggatcagatcggattaggattgatcgaaccggacgctgcgatggaggcgcttgaaacccttatgacgctgccggttgatcaagcggctttcattcatacgacaaaaccggtcgcagtcgaagggatgagtgaaacagaaaaaatttccgtttatccgtctcagccgcttgtctcttcacaacagctgaaggccgctccgcccggcgcacgtcttgtaaaagaggctgaacatcaaaagctcgatgattttctgtatcagcttttgatcgcccagcttaaagaagcagacttgctgacgccgcaaagccttaaagcgtatgagcccgaacacgaatattttaaaaaatggctcaatcaaacgatcgctttccttctggaacatggttatctggaagggaatgcggattcatataatttgtcggcgcgagccgaagacacaaccgcctcgctatggcaaaaatgggagcaggaaaaagaggaatggctcaataacgccgatacaaaagcgatgactgttttagccgagacgatgcttaaagcactgccggacattctgcgcgaagacgtgccggcgactgacatcatgttcccgcactcttcaatggaacttgttgaaggaatttataagcacaatcaagtcgcggattactttaacagcgctctgtcagatacattaacggcgtatgtgaaagaaaacatcagcaaacattcaaaagccgagatccgcatactggaaatcggagcgggcacaggcggcacaagcgcaggcatatttgaaaagcttaggccgtatcaaaactatataaaagaatactgttacaccgatgtatcgaaagcttttctcgtgcatgcggagacggaatacggcaaacggaatccttatctgacgtataagctttttaacgcagaagcgccgcttgccggccaggacatagagccgggcgcatacgacatcgtcgttgccgccaatgtgctccacgcgacgaaagacatccgccagacgctgagaaacgccaaagccgttttaaaagacaacggtttgctgctcttaaatgaaatggcgggaaacagcctgttcccgcatattactttcggactgcttgaaggctggtggctgcatgaagattccgcccttcgtattccggggtgcccgggcttgtatccggaaagctggaagcgcgtgttagaaagtgaaggctggcattctgtcttcttcccggcagaagcggcacatgaattaagccatcagattatagcggcaaaaagcaacggcgttgttcgccaaaaaacgcttacatcaggggccggaaaacggaccgctccgccaaaagcagcatatacgccggaacttcaggcgcaaacaacggtgcaaaaaggcgacacgtctttaacagaaaaaagcaccgagtacttgaaaacgttaatcggagaaacattaaaaattccgccggctcaaattgatccgaaagcgccgcttgaaaaatacggaattgattctatcgtcgtcgtacagctgacaaacgcgttacgaaatgtattggaccaagtcagcagcactttattttttgaatatcagacgatcgaggcgctcgtcgctcacttaatcaaaacgaaaaaagacgcgatgatcaaactgacaggacaaacgcctgttcaggaagaacagaaggcaacaccagaaccgcaggctgtacagccggctaagccgcttcgcactgactggcggcggagggaaaagcgggcagccaaagagcccgtccggcaaagttcggttcgcgacgtggccatcatcggtgtttcaggacgctacccgcaggcaaaaacagcggctgagctttgggccaatattaaaaaaggaaaaaactgcatagaagaaatcccgcgggaacgctggaactggcaggattactacgatgaagagaaaggtaaagaaggctctatttatacgaaatggggcggcttcattgaggatatggacaagtttgatccgctgttctttcagatttctcctttggaagcggagcgaatggacccgcaggagcgattatttttagaaacggcgtatgcgagtatcgaggatgccggctatacgcctgacaatctgtgccaaagcagaaaaatcggtgtttttgccggcgcgatgaacaaaaactacccgacaggctacggctactggtccattgccaacagggtatcttacctttttgatttccaagggccgagcattgccgttgacacagcctgctcctcttctttgacggccattcatctggcacttgagagcatatacagcggttcaagcgaatgcgcgattgctggtggcgtaaacatagtgaccgccccgattcattatatgaatctgtcagtcatgaacatgctttccgcaagcgacacgtgtaaatcgttcggagaccgcgcggacggttttgtcgacggagaaggcgtgggagcggtcgtgttaaagccgttggaccaagcgatcgccgataacgatcacatttacggtgtgattaaaggaagcaccattaacagcggaggcaaaacgaacggatacaccgttccgaatccgaatgcgcaggccgccttaataaaagaagctttcgaaagggcaaacgtcccggcgcgcaccgtcagttatattgaagcccacggcacggggaccgcattaggggatccgattgaaatcgccggattaacgaaagcatttgaagaggatacaacagacaaacagttttgcgccatcggctcagcaaaatcaaatatcggccattgcgaaagcgcagcgggcattgcgggtctgacaaaaatattattccagctcaaagaccgccaaattgcgccgtccctgcacgcggaacggctgaacccaaatattgatttcgcgtatacgccgtttgccgttcagcaggagctcggtgagtggaaacgtcccgtcatcggcggcaaagagcttccgagaagggcggggttaagcagcttcggcgcgggaggagcaaacgcccaccttatcatagaagaatatacggcagacaaagtgcctgatgagacgccggcagatcagcccgccatcatcgtcctgtccgcgaaaaacagcgaacggctcactgaaaaagcaaaacagctcagagacgctatccgtgaaaaaagatacaacggcagcgaccttatgagcatagcctttactctccagactggccgggtgccgatggaagagcgtctcggttttatcgtccattcactacatgaacttgaggaaaaactgaacggatttattgccgaacaaaacagcgccggactgcaccgtgacggcacggaagaaaacaaacggatgcttgccgtattttcggcggatgatgatatggaaacaatcatagacgcttggatcagcaaaagaaaatattctaagctgcttgagctttgggtaaaaggattggacatcaattgggcgaaattatacggagaccgtcctccggcccgcatcagcctgcctgcttatccgtttgcgaaagaacgcttctggcatcagcagcctgtacaaagcaaggctgcgcccgttaaggcgccggctgatgaaactgatccggcagaacagtttgaagtgatggcttttagagaagttcttaaagaacaggctctgccggctgccggagaaaaacaagtcgaaacggtgatttctttcttaactgatcagaagaagcagcaggaagccgtctctgtgatcaaatcgtatgacagtgacattgacgttatttttatcgctcagggagaccggtatgaggccttgtccgccggccgctgccaagtggtgcgggaagatccgcaatcatatgtgaacgcttttgcggatattcaaaaagagtacggtgaagcttccgccattttgtatttatgggcgcttgaagataaaagctgcatcgaagattattcatgtattgtccatattctcaaagcaatggctgagaccggtctgcagccggaaaggctgttattggcgggggaatatgcatccggtctggaaaggtgctacttggaatcatggatcggctttgagcgttcgctcggcattgttctcccgaaaacaagtgttaccggccacttcagaaaagccggtgcggccataacggactggatgagaaccatttgggatgagctgaaagctgaaacagaccataccgttttcttggaagagggaaaacgatatgtctatcacaccgaaccaaccggactaacgaaagaaaacggcaggatcagaaccggcggaacatatctcattacaggcggattaggagggctcggctacttatttgcccgccatctcgcccggaactaccaggcaaatgtcattctcacggggcggtcgccgatcaatgaagaaaagaaagaaaaaatgaaaggcctggaaaatctcggcgcgggtgttctttacgccgaagccgatgtttgtgatccgatcggaatgggcgactgcatcaagcgcgcgaaagaacgattcggagccattcacggcgtcattcatgcggcgggcatcgaaagcagaacatccgtctttgaaaatgaaatcgggaatttccgcagtacgcttgaaccgaaaataaacggaagcctgcttcttgacgagtggctgaaaaacgaaacgcctgatttcatctgctacttttcatccacatcggctgttttaggagatttcggctgctgtgattacgcggtcgcgaacaggttccaaatggcgtatgcccgctataaaaacgaacaatccgaaagcggaaacgcttttgtcataaactggccggtctggaaaaacggcggaatggccgtcggcggtgaagagacgacgggcatgtacctgaaatcaagcggccagcgcctgttagaaacagatgaaggcattgagctgtttgagcgcatcatttctcaagacaacacccagtgccttgtcattgccggcaaaagaagccgtgccgaacgatttttaggcatacggcgggacgaatcatcaaaaccggatgcgcttttggaaaccgtgagccgccgcatcccggaagaaagcacggaaaaacggctcgaagcggatttgaaagagctgatacacagtctgctgaaaatatctaaagataaactcgtcctgcataaaaactgggcggaattcggatttgattccatctatttagccaaatttgccgctcttttgtcgagtcattacggcattgaagttactccggcgttattttacagctatgccacgctcggagacgtcatcagctattacctgacagaacacaaagaaacgatcgaaacgttttaccgaacggaagaaaccgaaacagaagccgccgctccggataacaaggagtatacggatcaggagatcatcgccatgatgaaacaggtctctgaggggacattagattttaaaagagtgcaagacatcatagaagggagtaagacctatgaatcataaagaacttctcgatgcctacagatcaggaacgctcaccatcgctgaagtagaacaaaagctccaggctttcaagcggacaactgcaaaacgtccgctttctgaaggccagaaaggtttgtggatgcttcagaaaatgtttccggagatgagcgcatataacattccgttatgctttcgttttcaaaagctggatatcgagacattcaaaaacgcccttttgtccgtgcagcgccagcaccctattttgaccagtgtgataaaagaggaaaacggccttccgtatcagatagaagatacggatcggcattttccgattgaagaaatggatctttctgaattaagcgggcgtgacgttctttcgtttattaaagaaaaagcaaaagaaccgttcgcgcttgaaaccgggccgctccttcgtgttcatgtattccggcgggcgaagcgggagccgattgtgttaatcaccattcaccatatcatttttgacggcgtctctcttatgacgtttatgtcggcgctgctggacgcttatgtaaaagcaagtgaaggcaaagaacctgtcatggttcagcaggccgcagattatcatgattttgtgaaatgggaaaaagagctgctggaaagcgaagcgggaaaaacgcatctctcttattggaaaaagcagctggaaggaccgctgccggtgcttgagcttccgtcggattatccgagatcatcggttcaaacttgcaaagggcaggcgtatcagcgcttgcttcctgatgaactgaaccggcagattaaagtgtgcgcccaaaaacataatgtcaatgaatccgttgtgtatctcgctattttcaaagggctgctctatcaatatacgaatcaggaagatgtcatcgtcggcatgccgacgatggggcgctctgaggctcaatttgagtctgtcatcggatactttattaatatgatcgcggtcagaagcagggagacgggcgccaaatcctttacggcgtttttgaaggagctgcagctgacactggcagaagggctggaccatgccgcgtatccgtttcccgcgcttgtcaaagaattgaagacggaacgctcgcctgcggtttcgcctgtttttcaaaccgcgtttttctatcaaaacttcttccggacagaaggagcggaaaagctggcggaactatatcaatcactcggcatcgaaatgatagaagacattcatcaggaaggcgaatttgagcttgcgcttgaagtctataaaaaagaaacaggaaccgtcctgcaatttctgtacaacccggatgtctacagcccttctttcatcgaacggatggcggagcattatatgaaactggcagaaaaggtgctttctgatccggagatcgcttttgaagcctgttccggcctgctcaatcaaaaacgtgaagcaagccgttcatcccatcagccgaatgagcgctgcattcatgaagtgtttgcggaaaaagccggacgccaccctgacagagaagccgtcacattcggtgaaaacagtcttacatatcgcgaattagatgaacgaagcacggcgctcgccgtgcacctgcaagaaaagggcgtcacaccggaatgcccggtcggcatttgtacggagcgttcttttgagatggtcatcggcatcctcgccattttaaaagcgggaggcgcgtatgtgccgctggacccggcttttccaaacgaacggatggcgcacgtgttgactgacagcggcgtttcaatcgtattaacgcaagcaaagacgcgcggcatgattgaacagttggccatcggcggtgtgagcacggtggaaattgaaaacagcggacgttctgtcagcggggcaaaactgacgccgcgttcaaaaccgcatcatctcgcttatattctatatacgtccggaagcacgggaaaaccgaaaggcgtcatggttgagcacagggccatcatgaatacgctgcagtttttggaagctgagtatccggtcgcacaagaggatgcctatttgttaaaaacgaattacgtatttgacgtttcgatttctgaattattcggctggtttatcggaaacggacggcttgtcattttgccgcctggtgcagaaaaaaatccgcagctttgcatggaatacatccaaacccaccaggtcacgcacctgaattttgctcccgccgtgtttaatgtatttctggaaacggtaaagcggcatacggcatttacagaagacggccctgtgaaatatgtgatggtggccggtgaggcgtttccgaaagatttagtcaaaaagtcagtttccatcttcaaacatgccagaattgaaaacatatacggcccgacggaaacatctatttatgccgcttactacagctgcggccaaaaggaaatcacaagcaggaatacgccgatcgggaaaccgattcacaatacgcggctttatatcgtcgatgaaaagctcagccccgtccctgacggtgtggccggggagctttgcgtggccggcgccggtctggccagaggctattacaatcagcctgagctgacggcggcatcatttattgataatccgtttagtgaaggagaaaaactttacaagacaggtgatttagccagatggctgcctgacggaaatatagaatatgccggccggattgacagtcaggtgaaaattcgcggcttccgcatcgaattgggagcgattgaaacgaaattgaacgaacatccggacattcttgatcaggcggttgttgttcaggaaaagaacggacataaaaagctgattgcttattatacggcccgctccggtcatacggctgatgaaaaagcgctccgcaaccatcttttatcgagtctgccggattatatggcgcctgctcattttatccgtctggatgcgctgccgttaacaccgagcggaaaagtgaaccgcaaagacctaaaacagcgcaaggtaattgttcacaggtctgaaaagacgggcagactgccgttatcagaagcggaagcgaaagtgaccgcaatatgggaagacctgctgaatacggcgggcatcaaaaccgaagacggctttttcgatgtgggaggcgactcgcttctggctgttgcggcggcagaacgcattaaacaggagctggaatgcgattttaccgtcacggatttattcgaacactctaccattcaggcgatcagccgatttattgttgaaactaaacagacggctgaatcagaggtatcaggccaagatgaaagagaaagagaacaaacaccgcaaaacggggtgccgtcttactttgacgacagtgtggcgatagtggggatttcctgccagttccccggcgcgaaaaatcatcatgagttttggaagcagttaagagaaggaaaggaaagcgtccggttctactcggaagaagaacttcgggaagccggcgtgcctgaagatttgatcgaaaatcccgactatgtgccggcattatcgacgatagaaggaaaagatctctttgaccctgagttctttcacatttctccgaaagacgcagaatttatggatcctcagcttcggcttctgctgcttcattcttggaaagccgtcgaggacgcgggatatgtatccaaagagattccgaagacaagcgtatatatgtcggcaagcaataattcgtatcggtcgcttttaccggaaaaaacgacagaaggccatgaatctcctgacggctatgtctcatgggtgttagcgcagagcggcacgattccgacgatggtttcccataagctcggattaaaagggccaagctatttcgttcattccaattgctcatcatcattagtcggtctttattcagcctatagaagcatcacgagcggagaatcggaatacgcgctcgtcggcggagcaacgctgcatgcagcgaccggcatcggctatgtgcatcaaaacggattgaatttttcaagcgacgggcatgtcaaggcatttgacgcttcagccgacggtatggcgggcggagaaggagcggccgtcattctgctgaaaaaggcgtcgcaagccgttcaggacggagatcacatatacgccatgctcagaggcatcggtctgaacaatgacggagcggataaagtcggtttttacgcaccgagtgtaaaaggtcagactgacgtcatccagcatgttttagacagcacgaatattcacccggagacgatttcctatatcgaagcgcacggcactggaacgacattgggtgatccgattgaaatgtccgcgctgcagcaagtgtataaacgttacacggaccgggagcagtattgcggaatcggctccgtaaaaacgaatatcgggcatttggatacagcagcgggtctggccgggtgcatcaaagtcgccatgagtttatatcatcgggagctggcgcctaccattaattacacgtcaccgaacccgaatatcaaattcagcggttcgccgttttatgtggcggataagagaaaactgcttccggagagagagacgccgcaccgggcagcgttaagctcattcggactcggaggaacaaacgcacacgccatttttgaacagtatgaaaacaaaacgatcagcggattaaatgacggacagccgccttatatcgttccgctgtcagcgagaaataagcagcgtcttactgcctatgcatcttgtttatccggctttctggatgaagccgaaaacgatgtttccttgcatgatctggcatttacgtatcagaccggacgtgaagcgatggaagagagagccgtttttatcagtcatgatcatcacgatttgaagcgtcagctgcaggattttatcaacggcaatgaccaaaacatcttacggggcaaaaaagtgagaagcagagaagtgtcggctcaggagatggaagagcttgcggcatgtcagacacgtgatgaaaagctgaaagcatttgcggcgctctggattgaaggagcgcgtgttgattggggcttattgtatcaggattccgcgccgcgaagaatcagtgcgccgacctacccgttcgcagaggagcgcttctggccggaagaaactgtgaagcaaactgataccaagtttttgcatccgctggtacatcagaatacatccgtcttgcaggagcagcggttcagttcggaattcacgggaaaagagtattttattgccgagcatatcattaaaggaatggcgatcgtgccggctgccgtcacccttgagatggcacgggccgcggcggagaaaagcatcggcggggcaacagaggattctctcggcctgcgcttaaagaatatcgtatgggtacgcccggtgatagccgatcaggacgctgtccgtgtccatatcggactttatgaagaagaggacggacagattcaatacagaatgtacggcggtaacgattctatcggtgaagaagctcccctttataatcagggcatcgctgaaatcatccggaaggaaccggaggaagcggcggatattgagcagctgaagcgccggtgcacgcagggaacaatcgaatctcaagcgttttacaaaggaatgatcggagctgattacgggccgggctacaaaggtgtacagcttgtatacaaaggcgaagaccgtctgcttgctaaattgaagcttcctgaatccgtctcccatacgaaagctgattatatccttcatccgagtatgatggacggtgcgcttcaggccgccgaatatttgcaaaacgtgacgagagcgctgctggcagaaagcggggaaccattcaaagccgcattgccgtttgctttagaggagctggacgttctgaatccgtgcgctgatgatatgtgggtgcacgtcacattcagtgcgaacaataaagccggcgatcctatccaaaaagcagatattgatttatatgacaataacggcgggctttgtgtgcggatgagaggtttctcaacgcggatcatggaagaaaatgcgggtgccggcgttcccatcagccgtacggacacattgctcgctgaaccggtctggaaagagcagccggaaccggccgatcatgcgccttcgtatgaacagcatatcattttcctttgtgagttcgatgaagccgttaaacaagctgtcgaagcaaagcttgaacatgcaagcgtcattatcttggacgatcgtcccgcatctattgcagagcggtatcattcttatgcgggtcagctgtttggccatatcaaaaccataatgaaaagcaagccgaagggccgcgtgctttttcaggctgttacgcggtcagcaggcttacagcaggtgttctcaggcattaccggcctcttcaaaaccgcatgccttgaacattccaagctgatctgtcaaatgatcgaagccgaggagaaagaaagtgctgaaggcatcgcggaaaaagcgtccgaaaaccgtatgcatgccgaaagcgtccatgtgaaatatgaagacggcaagcgctttgccgctgattgggaagaggtggatatttctcaagcggagccggatattccgtggaaagacgaaggcgtttatctcattacaggaggtgccggaggtttaggtctgatttttgcaaaagagatcgcaaaccgtacaaaagacgccgtcatcatactaaccggccggtccgctctcagagaaaagcagaaagacatgctggaaacagtacgtgctgccggcgcttctgttttctacgagcagaccgatgtcacggacgaagcagaagtataccgattgatccgcaatatccgcaaacggcacggcaagctggacgggattgttcacagtgccggcattataaaagacaactacatggtgaagaagacggcagaggaattccaacacgttctcgctccgaaagtgaagggccttgtgtatcttgatgaagcgtcacaacatgagaaattagatgtctttattgtcttctcatccttatcaggtgtgcttggaagcgtcggccaggctgattatgcgtctgcaaatgtctttatggagatgtatgccgagcaccgccgttctttacaagccgcaggacaaagatacggaaagacgctttctgtcagctggccgttatggaaagaaggcggaatgcaggcaggaaagcagacggaagatatgctgatgcaggaggcgggaatcgcaccgctcggcacagatgccggcatcaaggctttatatcaaggcttgatgagcgggacagcccggatgacggttcttgaaggagatgtgaaaaacatgaaagcaaaactgtttcgcaaagagaatgatcatccggaagcagagaccggcgtacgtcatgacattgatgctgacagcctgcttgaaaaagtgaagcatctgttaaaacagcagacggcctcactgttaaaagtaaacattgacaaaattgatcctcacgaagaaatgacaaaatacgggctggattctatctcgatgactgagtttacgaaccagttaaacaaaacgtaccggcttacgttaacgccgacgattttctttgatcatccgacaatccatgaatttgccgttcatttaatcagtgaatacgaagaggaatttgccggacggtttgcggtaaatacaaaaacggttcaatcggcaagaccggtaaaagagactcaaatcacgcgcccggccgttaagcggcgccgcactctgcctgagacacttccgcagacagtgcagcgggaccaagggccggaaccgatcgcaatcgtaggcatcagcgggattttcccgatggcagaagacattgaagctttctggcagaacctgaaagaaggcaaagactgcatgaccgagattccgaaagaccgctgggactggcgggactattacggggatcccgcaaaagaagcaaataaaacaaacgtcaaccaaggcgggtttattgacggaattgccgaatttgatccgttgtttttcgggatttcaccccgggaagcggagcaaatggaccctcagcagcgcctcttgctgacgtatgcgtggaaagcgattgaagatgccggatatgcgtcaaagagtctctcaggcacaaagacaggtgtgtttatcgggaccggaaacaccggctacggttctcttttagccaatgccgatgcggcgattgaagggtcatccgcggcgaatacaagtccgtctgtcggaccgaaccgtgtcagctatacgctcaatctgcacgggccgagcgagccgattgataccgcctgctcaagctcgctcgttgccatacaccatgccgtttcttcaattgaagaagggacgtgcgacatggctttggcgggaggaatcaatacgattgttcttccggatgtgtatatcagttttgacaaagcgggcgcgctgagtaaagaaggaagatgcaaaacgttctccgatcaggctgacggttttgcccatggtgaaggagccgggctctttttcctcaaaaagctgaaagccgctgaggcggatggggaccatatttacggcgtcattaaaggaagcgcggtgaatcacggcggccgtgcggcatctttaacaacgcctaacccgaaacaacaggcggaagtcattaaagccgcatacaaaaaagcgggcattgatccgaaaacagtctcttatatcgaagcgcacggcaccggaacagaactgggggatcccgttgaaattaacggcctgaaacaagcgttcagctcgtttgcagacggaaaagagaaagcggccggctattgcggcttagggtcggtcaaaacgaatatcggccatttatcccttgccgcgggagcagcgggcattattaaaattttgctgcagatgaagcatcgcacattagtcaaaagtctccactgtgagacggtaaatccgtacattcagcttgaagacagcccgttttatctggtgcgggagacgatggaatggaagacgcagacggacgaacgcggaaacgaacagccgcgccgcgcgggcatcagctcattcggcatcggaggcgtaaatgcccacgtcgtcatcgaagaatacattccagaagacagagaggaagcagatgattctcatatcgacccatgtcttttcgttctgtccgccaaaaatgaaaaacgcctgaaagagcaggcaaaacagctgaaacgtgcgcttactgaaaaacggtacgatcattccagcctcgtttctatggcatatactctccaaatcggaagggacgccatggaagaacgcctggcggttattgccggatccgcagaagaactgcaggaaaaactgtcacagtttatcactggagataagcatgcggatttgtacagaggaagaatagacaaaggcacgctgcaaatgctgacggaagatgaagaaattcaagaagccgttgaaaaatggatggcacgcggcaaatacgcgaagctgcttgaattatgggtcaaagggctgaacgtcgattgggcgaagctgtatggagaccggccgcctaaacgcatgagcctgccgtcgtatccttttgcaaaagaccgctattgggcggcgaaacacaccggaaaacacgaaaaaacaagcacagtatctgccggaaaacaagacgcgcttcatccgcttctgcacagaaatacttcaaaccttgcagaacagcggttcagctcaatctatacaggagaagaattttaccttgcggatcatgttgtaaaaggcgtgccgattttaccgggtgtggcacatcttgaaatggcgcgcgcagcaatggaacaggcatctgaagtaccggccggacaaggaagcatcaagcttaagaatacggtttgggtgcggccgatcaccattgaagacgagccggtccatgtcaacatccgcctcattcctgaaacggcaaatgacgttcaattcgacatttacagcggccgggaaacagatcagccgtccgtttacagccaaggggcagtatcagtccgccctgacgcaaaggctccggtcattgatctgcaaaaactgagatcacaatccgccgagacaccgttttctgcagatgaagtgtacgatatgtaccgcaaaatcggttttgattacggcccggctttccggggtgtcaaagcgatttatacaggtgatgatttcgtattgggcagactgtctcttgatacggcttgtgcggacacggtgcaggagtatgtcatgcatccgggcttaatggactctgcattgcaggcatcaagcatattaaccggaacaaatgatgaaaaactgatgcttccgtttgcggttcaggagcttgaagtattcagcgcatgcgctgccgagatgtgggtttacgccagactttctgaagaccacaaagccggccagattgaaaagcgcgatcttgatatttgtgatgaaaacggcaaggtttgcgtaagtctgaaaggtttgtcattcagaacggctgaaaaagaacctgagaaaaaagaaaaagctccggaaacgctcatgcttgagccggtatggacacgaagcgatgaaactgccgttcaaacggaaccggtttttgcccggcatatcgtaatgctttgtgacacagacgccggattaaaacaagccgttgaagccgcgggagctgaatgtattgaaatgacctccccgcacgggaaagcggcggcgcgcttccgtgattatacaggacggatattggagacgctgcaaaaactgctgaaggaagagacggaaggagacgtccttatccagacggttctcgctaaaacagataagcatcagctgctctcagggatttcagctctgttaaaaacagccggcctggaacataaaaaactgaaaacccagctgattgaaatagaaccggcggaaaacggcagaatcacagacatcatcagagaaaataaaacaagggctgatgacagccatatcaaatatgaaaacggcatccgatacagcgcagatgtcaaagaaacggccgtgtccggcggaaaaatacgcattccgtggaacgacggaggcatttatctcattaccggaggagccgggggcttaggatttattttcgcgaaagaaattgcccggaaagttaaagagccgacactggttttgacaggccgttccgcattaagcgagaatcaaaggatgcagctgcaatcgcttgaatcactcggagcaaaagcggagtacaaacaggctgatgtaacaaacgctcaaactgcggcagacctggtcaaaacaattgaaacggaatatggcggccttcacggcatcattcatagcgcgggtgtgatgaaagatcaatatatcgcaaagaaaacaaccgaagagttttacagtgtattggctcctaaaacggacggatttgtcaaccttgatgaagcaaccgagcatttagcgctggactttttcatcgttttctcatccatttccggtgtcaccgggaatgcgggacaggcggattatgcggcggcaaacgcatttatggacagctatgcggcataccgcaacgcgctggttacggcaatgtaccgccacggtcacacattgtcaatcaattggccgctttggaaagacggcggaatgcaagtcaacgaagaaatggcgaagctcaccgaaaaaagaaccggcgtaacaccgatgcgcactgaaaccggaatagaagctctttacaaagcatggagcatggggaaaacaagtgtgctcgtcatggaaggaaaccgcgccgtaatgcgggaaaaactgcttcaaaagactcccgcagccgcttttgcaccggttaagaaaacggaggaaacgcctgcgccgaaagacctgacggccaaacttcaggaattgctggcaaaagaagtttccgggcttctgaaaataaacattgaagaaatcgatatcgaattggagttcaatcaatacggatttgattccattacgctgacggaattcgccaacaagctgaatgacacttatcagcttgatctcacaccgaccatattttttgaatatgcgacgattcaaaccttggcgcatcatttagcagaagactatcaaacacaatttgcaggcagcacacagccgaaagaagaaaaacaaagcggtgtaacagatgatggcggcatcagactggcagggaacaaacgatttgcaaaaacagccgtacagcctgttcagactgcggctgaacataaaccggaaccgattgccattgtcggcatgagcggagtgtttccgaaagccgcaaatattgatgagtattggcgcaatttagaagagggaaaagattgtataacagaggtgccggcggatcgctgggactggcgggagtattacggtgacccgcttaacgaagccaacaaaacaaatgtaaagtggggcggatttattgacggagttgcggaatttgatccgctgttcttcggaatttcaccgctggaagccgaacagatggatccccagcagcgcttgttaatgatgtatgcgtggaaggcgatagaagatgcgggatattccgctaaaagcctttccggcacgaaaacaggcctgtatatcggcacggggaataccggatacggctcactgttttccgacctggatatcggcggtgcgtcagccgcaaatatgagtccgtcagcagggccgaaccgcgtcagctatatgctcaatctgcacgggccgagtgaaccgatcgacacggcttgttccagctcgctggtcgcgattcatcacgccgtatgcgccattgaaaacgggaactgcgagatggcgatcgccggcggcgtgaataccgtcgtcacaccgcaaggccacatcgcttatgacaaagcgggtgcgctgagcaaagaagggaaatgcaaaacgttctccgacagggcggacggatttgccgtcagtgaaggtgccggaattctgtttttgaaaaagctgtcagaagcggaaaaagcgggcgatcatatttacggcgtcattaaaggcagcgcggtcaaccacggcggacgcgcgaactccttgacgacaccgaacccgaaagcccaggcggaagtcgtcagaacggcttatgacaaagcaggcattgatccgagaaccgtcacttatatagaagcgcacggaaccggaacggagcttggcgatccggtcgaaatcaacggcctgaaatccgcctttcaaaagctgtacgaaaaaacaggcgattccgccgtttacgcgagtcactgcggtctgggatcggctaaaaccaatatcggccacctgtcactggcagccggtgtcgcgggtgtgatcaaagtgctgatgcagatgaagcataaaacacttgcaaaaagcctccacagcgaggtcatcaacccgtatatcaagctgaaagacagtccgttttacatcgtacaggaaaaaagagaatggacggcattgaaagacgaaaacggcaatcatctgccgcgccgtgcgggaatcagttctttcggcatcggcggcgtaaacgcccatgtcgtcattgaagaatatatcccgaaggaagaaagaaaaacagctgttttcacacaccctcaaatctttgtgctgtcggccaaagaagaagaacgtctgcaggaacaggcgcaacagttggcgcaagcttcttttacggatgcggatcttgccgatgttgcttacacgcttcagcagggacgtgatgcgatggaagaaagagcggccattatcgcttcctcggccgaagaactgcgggacaagctaaagagctgtgcgaaaggatgttatgacaaagcgggcatttataaaggaaaagcgggggcgggtaaaaccccgctgaaatccattctggcaggcgcaaacggcgaagcggatatcgaagagctgataagccgccgagagaatggcaagcttgcggaattatgggtgcagggcgcggatatcaaatgggacggcttatattctgatatcaagccccaacggatgagtcttcctgcttacccgtttgcgaaagagcggtactggatcacggacaaccggccgaaagcagaaaaaccgcaagctgtgccgacggcgcgggtgctgcacccgctgcttcacgaaaatgtatcggatttaacagagcagcggtaccgatccgaatttacgggacaagagacgattttcaccgatcatcttattaaaggcaagccggtcatgccgggcgttgcctacttggaaatggccagggcggcggttgctcaggcagtcaaagggcaaaaggaacgtccttctgtcatccgtctgaaaaacatcgtttgggttcggccgatcgaagcgggaaaccgcccgattgaagcgcaaatcagcctgaacccgagggaaaacggtgaaatcgtgtatgacatttacaccgattcacaaacagaagcaagcggcaggcagatacactgtcagggggctgccggcattctcggcgccggtgaggctccgcaccgtgatataggcgcactgaaagctcaatgcggtcgcagcatgctgacttctgagcagtgttacggtttattcagcaaaatcggcattgactacggtcccggacaacaaggaattcagcacattcatatcggaagcaatcaagcattagctgagctccgtctgccttccttcctcgaagaaacggcagatcaatacgttcttcacccgtgtatgcttgattcagctttgcaagcgacaatcggactgaagctgcatgcaggtgataaccagctgtcactgccgttcgcccttgaggaactggacattttcagcccgtgcacgacaagcatgtgggcgtatgtcagctcccggggaacggatgaaaaaatacagcggctggacattgacttatgcgatgagacaggccgcgtctgtgtcaggattaaagggatttcttccagaatgatggaaggcccggcgccggaaacatcattaaatggagcaaaccttctggctccggtatgggatcttgcggaattccgtgaccaaagcccggcatataagacggaagaggttgtctttatcgcaggggatgaggaaagcgcggcttttcaattgcatcatccttctgcgaaacggcttcatatcaacccggaggatgaaatagaggctgttgcggctgaaatgaaagcaagagggtctttcgggcatatcgtatggatcgctccttttcacagcgatgatgacatggtgaaagctcaagatgcgggcgtcatccagatgtacagagtgattaaggcgatgcttgctttaggatacggaggcaagcgaatcagcttgactgcagtcacaataaaaacacagtccgtacagccggcggacatcattgatccggctcatgcaggcattcacggtttgatcggttcgctcgcaaaagagtatccgaactggcaaacacggctgattgatgccggatgtccggaagatgtttcaaaggcggagctgttctcagcgccgtttgatgagcaaggcaacacttgggcgtaccggaacaatcactggtacaaacagcgccttattcctgtacagcagccggtgtcaagccggcccgcttaccaaaaaggcggcgtttatgtcgtcatcggcggcgcggggggcatcggcgaggcatggagcgaatatgccgtgaaaacgtatcaggcgcgagtcgtttggatcggcagacgaaaacataacagcgccatccaggaaaaaatcgacagactcagccaatttgggccggcgccgatttatattgaagctgacgcggcaaatccggatgagctcacacgggcatatgaaacgattaaacgcacgcacccgcaaattaacggaatcatccattccgcaattgttttagaggatcagagcctggcgaatatgccggaaagtcgtttgaaaagcgtgctcgctgcaaaagtcaatgtcagcgtgaatatggcccgcgtgttccaaaatgagccgctggactttgctttgttcttctcatctgttcaatcatttgcacgagcggccggacaaagcaattatgctgccgggtgcagtttcaaagatgcctttgccgctcatttggctcaagtccggccgtattcggcggcagtgatgaattggagctattggggcagtgtcggaatcgtatcatctgccgaatatcaagaacggatgaaacaggcgggagtcggatcaattgaagcgcccgaagcaatggcggcgcttgaacgattgctcggcggcccattgaatcagttcgtcatgatgaaacaggcggaagagccggaggaaaaaccggaagaaatgatagaagtataccctgaacatcacggctcggcgatgcaaaaactgcgaagctatcagcctaaagtaacaagacatgtacaacaattgagttaaggaggggacggctttgcaaaacactgaagatcttctttacaaactattggcaggccagctgaaatctgtcggattttttacggaaaacgaaacgcagcctgtcatgcaggggttttacggcaggtggctggaagaaagcatctccatcttggtgcaaaaaggctttttgaaacagtctggcagtacgtatgtgttaacgggtccgatagagcgtgcggacgttctgtggcaagaatgggatgaaaagaaagctcctttactcaaggacagcagcaaacgggcgatgatcaccttagtggagaccgctctcagagctttgccggatattttatccggcagagtttctgccactgatgttctgtttcctgattcctcaatggaattggttgaaggaatctataaaaacaatgaaacggcagactactttaatgaggtgctcgctgacacattgacggctttcattgaagaacgcctgaaagaagacccgaacgcggaaatccggatattagagatcggagcggggacgggcgggacgagcgcggccgttttcaaaagattaaaagaggtcaaacctcatgtgaaagaatattgctacaccgatctgtcaaaggcctttttcatgcatgctgaaaaagaatacggtcccgacaatccgtatttgacttataagcggtttaatgtggaagagcccccggctttgcagggtatagaggcgggtgcatatgacgcggtaattgcggcaaatgtgcttcacgcgacaaaaaatattcggcggacacttcgcaatgccaaagcggtgcttaaaaagaatgggattttgctattaaatgagatcagcagccattcggtttattctcatctgacattcggtcttttggaaggctggtggctgtatgaagacgccaaactgcgtattcccggatgccctgggctgtatcctgaagcgtggcagtctgcgctggaaagcgagggatatcggtacgttacatttatggcggaatcgtcacatcacctcggccagcagatcgtggcggcagaaagcgacggcgtcatcaggcaaaagcagccggacgcgccggcggttgaagaaattgcggcttccaaagagccggctgatttcacagaaccgtctttctcagtcacagaccggacggtgcaattcataaaagaaacgttagccaagtccataaagcttgctcccgagcgcattcagccggaaaccagctttgaaaaatacggcatcgactccattttgcaggtgaattttatccgtgaactggaaacattgacgggcgagctgccgaaaacggtcttatttgaacacacgaatacgaaagaacttgccgagtatttgctggaaacttacccggataagctgcaacaggcattcggagccgatcaagcgcctcctgaaacggagcatccggaacctgcaatgaatgaaccggtgccgcttgtcacggaaacgcggcgatttatcactgaacaaaaagagccaaaagcgccaaagccggaaacagaaaacgtcaccgataatcgctcagatcgtgacgacattgccattatcggcatcagcggccgctatcccgagtctgaaaccctcgatgagctgtgggagcatttaaaagccggagacagctgtattacggaagctccggaaaacagatggaagtccggtcttctgaaaacgatggcaaaagaaacacgaaaagaagaacgcaaaacacggtacggcggatttctgaagcatattgacgcttttgaccatcacttgtttgacatccgggaagaccatgtgatggagatgacgcctgagctccgtctaagccttgaaaccgtatgggaaacatttgaaaacggcggctactcgttagaaagagtaaacgaatggcaggaatcagacagcgggatcggtgtatttatgggcagtatgtacaatcaatatttctggaatatcccgtcattggaaaaagctgcactcagctctaacggaggggattggcatatcgccaaccgcatttcccactttttcaatttaacgggtccgagcatgggcgttacgaccgcatgctccagctcactgagcgccattcatctcgcctgtgaaagcctgaagcttaacagctgttccatggcgattgccggaggggtcaatctcacgcttgaaccgtctaaatatgatgcgctcgaacgggcgaatttgcttgagcagggaagtgaaagcaaaagcttcggaaccggcacgggcctgatgccgggagaaggagtcggagcagtgctcttgaagccgctctccaaagcggttgccgacaaagaccatatttacgggatcattaaaagcagcgcgttgtgccatagcggcggaaggcagatgtacacggctccggatccgaaacagcaggcgaagctcatggcggcttccattgacaaggccggaatcaatccggaaacaatcagttatgttgaatcagcggcaaacggctctgtattgggagatccgattgaggtcattgccctgacaaacgcgttctcgcaatataccgataaaaaacgattttgcgcgcttggatccgtcaagtcaaatctcggccatttagaggcggcctccgggatgtcccagctcgcgaaagtgctgctgcaaatggagcgggaaacattagttccaaccattaatgcaaaaccgcaaaatccgaatatcgcgcttgaacaaacggccttttacctgcaggagaaaaccgagtattgggagcgtctgaaggatgccgagacgggagacatcataccgcggagaagcatgatcaattccttcggggcaggcggggcatatgcaaatctcatcgtagaagaatatatcaatccgaattctaatcatgcccgtcacggcaatgaggaatatattttccctgtgtcagcgaaaacaaaatggagttttgaagcctatcttgagagactggcggcctttttagaaaagacgccatctcttcatccggccgccatcgcatccgcgctgcaaaaaagaacgcatcatccggagtatcgggcggcatttacggctgcttccgttcaggaactgtcggaaaaactggccgcttaccgcatggatcagcggaatctcaatttctccgattctgatatcggccggcgtgcgcggcaatgggaaaaaggagagaatatcacgtttgatcagttgcagcaagagcacgccgttcatctgccggcctacgcttttgaccacgggacttcttttcatttcggtgaatcagaaaacgctgccggcgttcaggcggtatacagtgatgacgacccatacgtgaaagggcatcaattcagcggagaaccggtactcgtcggcgctacatataacagtctggcagtcgatcatttttgtgatctttttcctgaagcagagggaggacatattaaaaaactgaattacgtcagccccattaccgtaaaaaaaggcgatcgcatcgagctgaaaacagaatcgaaacaaaacggggatggatttgaactgagcataatgcaccgcagccgcacgtctcctgattggagcatagcggcgtatgccgagtgcagcccgtatccgtttcaaaagcagcacgcggatctggcggccattcagcgctcataccgggaagtgggccggatagatgagttatacggagacggaacgggaaccgtcgtgtggggagaagaatttaaaacgatcacccgcctgtacaaaggcactgatgccgttttagcgaaagtgaacctgaacaatagcgactcacaacaagcgcatcattatgccataaatccgttaatcgccaacagtgcttacttggcctcgctttctttattggaccaaacagaggcggaaagctatctgccgttcggcattaattccgtcaccttcagcagcccggaaaatcttaccgattgctggctgcacatcaagctggccaaacaaacgggggaaatgattctgattaacgcagatgtcatcagcagccgatcggaagtggtgatgcgttttgaaggctatgccctgaaacggttccgcccgaaaaccgaacagatgaatcagccggcccgaacggctgttaagaatgcgggagcaccgatttctgccggcagtctgacagatgatatccgcagctacgtccttggcaagctcgccaagatgatggatgaacccgcgtcctctcttcgttctgacgcgaatatcatggaattgggacttgattcagcgagtctgatcgggctgacaaaagagatcggccaagaggcggacatcgatgtgaatccaacattgtttttcgagtatccgacggcggaggagctgacccgccacttcgcgtcagcatatgagagcaagttttctcaattgcttgccgatcataagcattcagaagaggctggggtcacggaaacagaagagcgcactttaccgaagaaacagcatacgccttgtgaaaacgccgatgtcaagcaaggaatcgcgattatcggtatgtcagctcagtttccgcaatccccggatatccagtctttttgggggcacatcgtaaacggggatcgctgtattaccgaaattccggcggaccgctgggactggcgccgttacgccggcgatgagaatgacacgagtctcagatggggcggttttattgacggtgtcggagaatttgacccgctctttttcggaatttctcctaaagaggcatcacaaatggggccggagcagtttctgcttttgatgcatacatggaaggcaatggaggatgcgggcctgacaaataaggcattatcaagcaggacgacaggcgttttcgttgccgcgggcaacagcgatccgaacaatggaacagccattccgtccatcattccgaacaggatatcatatgccttgaatttacaaggaccgagtgaatattacgaggctgcctgcacgtcaacgctggtggcattgcacagggcggttcaatcaatccgtcataacgaatgtgagcaggctgtcgtgggcgccgccaatattctgcaatcgccgaaaggttttatcggttttgactcaatgggatatttaagcaaaaacggccgggcgaaatcgttccaaaaagatgcggatggctttgtcagaagcgaaggggcgggcgtgatcatcatcaaaccgcttgaggcggcaattgaagacggcgatcatattcacatggtcattaaaggaacaggagtgtctcacggcggtaaaggcatgtcgcttcacgcaccgaatccggcgggaatgaaggccgcgatgaaaaaagcgtacgaagacaccgatgttgatccgcaaaccgtcacttatattgaagcgcacggcattgcctccgaaatggcagatgcgctggagtttaatgcaatcaaagcgggttacggcgagtctgcaaatcaagaggaaagcacgccttgttatatcagcaccgtgaaaccttgcatcgggcacggcgaactcgcttccggactggccgcccttataaaagtagcgatggccatgaagcatcataccatcccgggcattcccggatttacagctgcaaatgagcaaatggctattcaaaaaagccgcttccgtttcaccgaagacaatcaggaatggacacagctcaccgaccatacgggcagaccgatcccgcgccgggccgcaattaacagctatggcttcggcggcatgaatgcgcatgtcgtcttggaacagtacagcccgagccataaagacaaagaatctgagcatgacccgcagcttatcgtgctttctgctaagagcgaagggcgtcttaaggcggccgcaggtcagctggctgattttgtgcaaactggagatactccgtcattgcgggatattgcttatacgcttcagaccggccgtgaggcgatgaactgccgcttggcactcgttgcccgcaatcaagatgaattgctggaaaaactgaaagagtacagagcattttccgaagaaagcaatggaatgaaaagcttctttacaggcagtcagcagactggatcaggagatatcggcgttttactggaagggactctcggtacagtcgtcacggagacgctgttggctgaaaacaatctggaaaagcttgcattttgctgggtgaaaggagcggatataccgtgggacagactccaccaaggcgaatctgttcaaagagtgccgcttccgacatatccttttgaacaccacaagtattggaacggcggtcagccagaagagatcagccttgcaccggtttcccaggaccctcagctccgccgcgagagcgcagctgacattgtggctgacattttggggatgaaggcagcggaaattgatcaaaataagcccctgactgaatacggattcgattcaatctcctgtattcagctgctgaaaaaacttgaggacggagacagccgcatcagtctggaagctcttcagaaatgcagcactcttcaggagatcggcatgctgttaaaaacgaaccaaccgcatgaggcgggccggaattttcccgaactcgtcaagctgaatgaaagagaaaaaggccgtcctgttttttggtttcacggcggaacaggaggcgttgaagcataccagccattcgccaaaaagagtcagcgtcctttttacggcatccaggcaagaggtttgacagggaaagagccgctgcaaggaatcgaagagacggccgcttcttatatgagaatcatccaagcggtacagccgaaaggcccttatgacctcggcggatattccttgggcggaatgcttgcatatgaaaccgcgcgcctcttgcaggaggaaggtcatacagtaaaaagcgccgtcatgatcgacaccccgtacagtgaaaaatggaaagaaagaaaaccatctgttaagtcagtcatgctgcaaacgatcaatacgatgcttacggcatatcttaagcctgaaaaccttgaagaggcattaatcagcagagaagacattaccgtccaggctgaggaagaagaagtattgaaagaattgatcggccttgccaaaaagcgcggtctgccaaaatccgaagaagcgatccggatgcagctggagcaaatgatgaagacgcagctcgcttacggaatggaagagtatgacatgaagccgctgcctcatccggaagcgctgcaatgctactacttccgtaataaaagcggtttgttcctcggagatcttgaacgttatctgacagcagaggaagaacaaattccgttagaccatgatgcgtattggaaagaatgggaacaccagatgaaacactttcacctgctggacgtccactcctccaatcatgtcacaatgctgtcggaaccaaagccgcaaaacgccattaaggcattctgcgaaaaactgtacgcaaacaaaggaacgataagcgcaaatttccttaaatctttcagaaaaaagctggacgaaacaaatgagttggtaaaacggtaatagagaacggccggagcaatccggccgttttttttatacatagaactaaattcattatgtactaaatatttactattatattgatttcctgtttataagacattaaaaaaacccccgataaacagggggcgatattaaaatctgacaggcaatgtttcaagccctctcaaaaacacgttttttctccatgttacatcctcgggcgcgcctttcagctctatattcgggaaccgttttaaaagcgaagtaaaggcaatggatgcttccatccgggcgagcggagccccgagacaaaaatgaatgccgaatccaaaagagatatgacggttcggtgttctcgctatatttaatgtatcaggatcatcgaaatattccgggtcccgattggctgaaccgatgccgataaatatcatatcgccttttttaatagaaacatctttataggtgaaatcttcaagcgcccatcgattcgccatcatgatgacgggagaggtgtaacgcaaaagctcttcgaccgccgtctggatattttcgggctgccgctttatcttctccatctggtctttgtgcagaagaagcgccagggtgccggagccgagaaggttaaccgttgtttcaagcccggcaacgactaacaaaaacagcatggaatacagctctgattcactcagcttttggccgtcctcttcagcgtaaataagcttggttgtcagatcttcagccggatgttttcttttttcttcgatcagtgttttcatatattgtttaaattctttgagagcctggttggtcgcatcttgtccgctttctgacgtgtcaaccatcgcgttagtccacacttgaaatttggcgcggtcctctttcgaaattccgagcagctcggaaatgacgataaacggaaggggtgccgcgaaatctctcataatatcagggtctgcttttttttccatttcatccagcagctcttctgtgatctgctctatcccggtgcgaagctgctcaatcatccggggagtgaacccctgatgcaccaaagatcgaagacgtgaatgatccggagggtcttttgccagcatatgctctgagacaaaatcgatatcttcgctgacattcagctttgcgatcagctccttcggcatgacccgtcttacatctctcgtaattctgccgtcttttaaaaacgccatacaatcatcataacgcgtgatgagccatgccggaaaggtgcctccgaaacgctgcagttcgaatttatgtatggggtcctgctctctgaatctgcttaaaaccgcaaaagggtcttcgtgaaactcgggtgagtgtgggtgaaacattgttttttccatctggatttccccgccttcatgtttttgaaaagacataaccaacagccggtgcctgccgaccggacggcattcctccttttatctgccgaagacactgatcacaacggctcataagtatgtctaaaatatataaggaaacagaagccggttcaatagataaatcgtaaagccgccattttcgttaattatcaacaaaacagcaaactttttttgccaattcatcatgtgtgttaaatccggctaatatacatatttacgcttcatatcaacttcttaaggaggatgtgaatgaatgcgtttatgaaatgggcggcaagtctgcttttggtgatctctcttcagttcggccttacgggcgccggcatccattcggacagtgctgctcgtgccgcatcccgatacgatcaggtgctgtatttcccgctgtcaaaatatccagagacgggaaatcatataaaagacgccatttcggcaggtcattctgagatttgtacaattgatcggggcggagcggagaatagaaggaaagaatcattgaaaggaattccgacaaagcccgggtttgaccgtgatgaatggcccatggcagtctgcacagaaggcggggcgggggctgatatcagatatgtaaccccgtcggataaccgcggggccggttcatgggttggaaatcaaatgagcggctattccgacggcacgagagtattatttatcgttcagtaacttctccggttcgccggagtttttttatgctttgaaaaagcggcacgccggctggacatatgaaatggcaaagagtaaacttatatgttggaatcagcataagaaaggattggatcacattgacagtgactacataccgaaatattgcacttttacttctttgtttaacagcgggaattgtggatgtgatcggttatttaagcctgggacatatctttactgccaatatgacggggaatatcgttctgttcggcctggcgatcggcaattcatggcaccttgccgtactcaaatcgttaacctcgttaatcggatttattgccggcgttattgccgcggccctgcttgtgggcaataaaaagaaatcattctggccccctgcggtaactgccgctttagctattgaaggagctgttttgctgctgtttgctttgttctcttgcttttttgcagatgccatttctgtttatgtgctgattatgctgctcagcttcgcaatgggaatgcagacgacagccgcgagaaaacttggtgtagcggggatttccacgaccgtattaacgggaacgctcgctaatttttttgaagatctcaccgcaaggttttacaaagcggacaagcggaagcagtttacgagagatgctgtattgcgcgcacttgccttggttctgtattgctttggggcggtcataggcgcttttgccgaaccggattataagtttgccgtgatctggctcccgattatcattattttaggcattatgctttgcgcattcacgatgttccacggatattctgaagaaaaaaaccaataaaaaaacgccgctgattcagggcgttttttctttttattgctctttccgggtcccgattgtatacacggcccgatctgtatgtacctttaatccgtcttgctccttttggatggtaatgtcgccgagcagaggaatttcatacgcatcttgaggaagcgggacatttccttcctccgtataggttgtgccgtgcccttttaagacgagttcttcatccgctacatagtcatcgggatggtttgtccgccggacgagaacatcatcaaggtgaagcatgatccggtccatatcagaaatctcgtttcggctgtctgtcagctctccttttctgatatcaagcgtttgtccgatctgtttttgcagccattcagacaattcggtgtttgtaagtgccattgtgattcctccttttatctacaccatacttattccctatttttttagaaatacaccgccttgcattgatctttttttctgacagccggttctgacctgttccgagttccttcattataaatgtttcatctattcacctgaaaaacggagtcatctgccggtgcagacgaccccgttctcatgataaaaaggttactctttcggcacggcgttttcagcgttcactgcgcccgctccgtaaatgttcggatcttcatttgtccattgatccggactttgtttgatcaatgttttcacttcgtcaggcgaaagctgcgggttttgctgaaggattaaggcagcgatgcccgcacagatcggagtggccatggacgtgcccgaaagactgaaatacaaggagcctactcggtttgatttctgtaatttgtcaagatatgaacgcggagaacggagagatactatatcgaccccgggcgcaagaatgtcaggcttctcttttccgtacaccgtcgggccgcggcttgagaaagaagcgaccgtatcgtcctcattgctggctgtatcattgtcatcataggcgcctaccgtgatgaccttctcgctgacaccggggcttgaaatcgtttgagcttccggaccggagttgcccgcggcgacgcagacgacgattccttcattccatgcctcttcaacggccttgacgagcgggtcgtccgtttctttatcatatctgagcgcatctccgcccagtgacatgctgatgattctgatcgggttctttgtgtgttctttattatattgtatgcaccattccacaccttcaatgatatcagccaaggttcctgatcctgatttgtttaaaaccttgactccgatcagatcggcttccggcgccggcccctgatatttacccgaagatgaagcgccgctgcttgcgatatcaccggcgcaatgggtgccgtgcccgttgtcatcatacggttctgtcttttgattgacaaagtccgcaaatccgataatcctgccttctaaatcgggatgctgatagattccggtatcaataacggcgacggttacgccttttcctgttaatacggtgccgttacgggtcacttcttttgcatgagacgattcagctgccgtatcaaggagagcttttacttcacggtttaaatagattttacgaatatcccggcattgcgaaagaagcatgtgaagggcggacggagtgacttcggcgctgcagcagttgattgtttgaaactgcttttttatggtgcagcgtttttcttttgataagacctgtcctgtgctgtgaaaaccggattcatggcagccctcttcaaattcaatgatgactgacattttctttctgtttttcacctttttttcgaaaaaattgtgcaaaaagcaaggtgtccatttgaaaggtttatataactgtaatacgttttctctgagcggccagtccagcttatgagcatttgaccgcaccatttgtaccattgagtaaccaaacatatatacttttcctcccattctggcgattctctctataccatatgaacaggccgtatgttcggtcagtttgtttgtccttcaggagagctggttacttgcggctttttcaggagaagaaatcgagttggatcggaacgtttgttcgtttatgatgaatccggcggaaggaggtatacacatgaacatcatattgagacattccttggaaaaacagcttccgattgatattatatatatgaaaaaagacggctctatttcaaaacggaccattatgataaaaaaaggggatgagcgggctgtaacggcattttgctgtacaaaaaggcagatgagaacttttttgacgggctccattctgtcctgcgcatttgcttcgggaggcggatattcatttttaaaagcgtattcttgatgccgtccgtttccggccgtgaatctcccgcccctgaaaattcgggcgttcctccctttttttttgccctctctcaaccttttttcactgatgcccggcatttgagcgcttgaaccgtgacaatccattgatttttcgaaaccgggaagtttttcactgatgataatgttaatagaatgttaagataagacctattgacaaaaatccatataatgaatatttcatttttcagaaaggagcaaagaaggagagctgatgaaaagaattttacttaatgtcatcattatcgtagcaatggtcttactaataagatgtgctcattatgcgtcagaccctgatccctcgaattcttctgatacatacacagattttaaagatctggctgaacatgaagaccccgatgattatcatatatcgtacaataagcgaaaggggagccccgtattgatcatgtcgccgcacggagggagaattgagggcggggtgagcgagatcgtccgctctttcagggatgattattcaacctacctgtttgagggattaaaagcgcatgataaccagactcttcatattacgagcaccaagttcgatgagccttcagcagtcgaaagcattaagcagcaccattatgttatcgcagttcacggttataaaggcgacgagaaaaatactcttgtcggaggaagcgaccggaagcgggcgaaaaaattggtgagagctctcaaacgaaacggatttcctgcagaattggcaacctcaaaaaccggtctggccggggttgacaccgaaaatatcaataaccaggctcaaaccgggcttagtatacagcttgagatcagcagagaacagcgggaagcgttttttgataattttgattaccgcgaaagggaattcacaaaaacggaggaattttaccggtttgtccgtacgataaaaagagtgatcaatcaagagtattcgtgagcttaaaaaaagacaaaccagtgaaaggtgagtaaactgaaaaaaaaggaggtttgtcccttggcaaaacatcacttttatttaaaagcaaattggcccggaaatcgcaatgacgtcggcgatattaaaagcggccggctggaaacggctgtgtccattcctaaggaaatggacggacccggagaaggcacaaatcctgatgaaatgctgcttggagcggccgcgacctgttatattataacgcttgcggcgatgatggaaagaagcggtctggataaagaagatctacatatggaatctgaaggaattgtagacgtcacgaacggtgtgttcacgtaccagaaaatcattcaccgcccgtttatattattaaagccggatgcagccgaaacggactttacgctcgccaggaagttagcgcaaaaagcggagtcctcctgtatgatttcacgagcgatccaaggaaacgtggagatggagcttgaggttgaagtaaaagctgcccgcgcttgacgagttcaaacggtcagctccgggccgtttgattttttttagctttttgagacttggaacggttcagcaggatgacgcccgtgatgacaaaaataagcccgatcatcattttggctgtcatggcttccttaaaaacaaaaaagccgacaattgccgttaaagccgtgccgacacctgaccatgtcgcgtatgcggcggataaatcaaggcttttcaaagagaagctcaaaaacataaaagaggctccgattccggcaatgacgccgagagcgggccataagtgcgtaaaaccgtccgacagcttcagcatcgtgcttccaaacacttctgatacaatggctaatgccaggcagagtaatcctttcatatcatgcttctcctttctaccaattcatcagaatgacaccggccaataagaatacaagtccgatgacggcctgcttgtccagtttttcatgaaaccatttcgctccgataatggatgcgagcaccgttccggctccgctccatgttgcataggataagctgagcggaatgagattcagtgtcagtgaaagcatataaaaggccaatgaatagcctgccactacaagcgcgctcggcaaaaaccgcgtaaatccgcgggagaccttcagcatggccgcgccgattgactctgataaaatagcaattgtgaggaagatataacccagaatcatatcaaatccccctctcatcataatccttatgccttttgtttaaggcagtaaaataaaataatatccgaactttgcccgccaagtcaagacattaggcctatataaaaaggcccctgaaaggagccctttttgattgtcttagtagtaatacggatagtaagggtagccgtaacctccgtacaaatacggattgaacaaagcgcttccgacaagccccccgacaagccctccgacaaacggtccgccgtaaaaaccaaacggccgtccgaacccgccaaaccaagggcggccaaaccaaggccggccaaaaccaaaacccggccgcccgaagccgaatccgaatccgggacgcccgaacccgaagcccggccgtccaaacccaaatccgggccgtccaaactgtctcatatcactatctgcttcgtatgtgtattcttcattcataatttaggtacctccaagaataaatttgagatgataacagagtattcagcccaccaatttttgattgggcgtttatcaaaaaataaaggagtgatcttttgtgggcctgtatcagtccgattggtcaaaaaaacctccgcacacacacgcataccgggctgttacggatgtagtgcaggggcattaccatgtgatcgaaggcttttcgcagccggagaacggcagcaatacagatgagcatacacatttctatacgggcatcacctcgtttgaaaacggccattttcataggtattacggcatttccggccctgccatcccgagggttgacggaacacattaccatgagctttcagagaccacctttgccgcctacaatgagccgattcagatccagcacggcggcgtcgtttacgatccgcgggagaaaggacggaaaacgcaccgccatacgctcaaaggaaaaacgagagaggttgtcggaaacgagccgatcgggtggtagcggatgtttagcgctcaggaaaaagggcaaaatggataggtgcctgaagaaatgaatgctataattagggggagatttataaaagagagtgatacatattgaaaaataaaaaacagcctgtcgtcatactcgtcggaccgacggcagtcggaaaaacaaaactaagcatcggactcgcgaaaatgctgaatgcggaaatcatcagcggagattccatgcaggtatataaagggatggacatcggaacggccaaagtcaccgaagaagagacagaaggcgtgccgcatcacctgattgatattttggagccgtccgacactttttcaacggcagattatcagaaaatggtaaggggaaaaatcaccgagattgccggtagaggaaagctgccgatgattgtcggggggacgggtctgtacattcagtccgtgctgtatgactatacgttcacggaaaactccggcgaccctgtattccgggagcgcatggagaaactggcggctgaagaaggggcggaagcgcttcatgccaagcttgcggcagccgatccggaagcggcggcagccattcatcaaaacaatacgcgaagagtcatccgcgcactcgaaatcctgcatgtatcgggaaaaacaatgtcagagcatcttaaaacccaaaaacgggagctgctttacaatgcggttcttatcggtcttacaatggacagagaagtgctgtacggccggattaacgagcgcgttgacctgatgctggaaaccggccttcttgacgaagtaaagcggctgtatgatatgaatatccgggacagccaatcgattcaggcgatcggctataaagagctgtatgaatatcttgatggaaaagtgccgctccctcaggctgtggagcaattaaaacaaaattcaaggcgatatgcgaaacgccagctgacctggtttcgcaataaaatgcccgtttcatggacagatatgacgccgcctgttgatattgagcagaaaaaaaaggaaattttcgagtgcatagcaggaaaactggaaatttaatcgaaacagtattgtattgagaaccaaggaggacgaaacatgaaaccgattaatattcaagatcagtttttgaatcaaatccgaaaagacaatacgttcgtcacggtgtttttactcaacggctttcagcttcgcggccaggtaaaaggctttgacaactttaccgttttgctcgaaacggaggggaagcagcagcttatttataaacatgccatctccacgttcgccccgcaaaaaaacgtccagcttgagcttgaatagactttttgacaaagaccatgaacaatggtctttttctatgcgcgtctgtatattgcaggccgtatatcggaaagataaaagggggtacggaaaatcgtgttcgaaagtgaaaatgaactgagaagaatcaggattacgctcgtttggatcgctgtttttttgctgtttggagcttgcagcaatcacgagacggtggtgacggatgatgacggcggcttggcggatgccgaaccgcagacagaaggcgtggtgcagctggaacataatcgtttcggcattgtcgaggacggttacttaaaaatataccgctatgatgaaaaaacggataaaatcgaactgaaaaaagaaacggcgctggatgagcttgaataaatttcacaagcgttcgaatttacaaagcgggccgcacaagctacactaagtactgacattgatcatgcagagggtgagacgattgaaacacaaggtgataatcaaccattgggaagaaacttgtgaagatgattcctgctatgaatatggaaccagcatcatcgttgacggcaaagaactgatcagagaggcttccatcacaagcgctctgaaagccgtactgaaagaaatcggtgctgatgtggagattgaagaaaccgttgaaagcgaaaaaaaatgtgattcttacaaaaaataagaataaaagtctagactactaagcagttttttttcatgttatgatagacatcggcttacacatgacaccttgagtaggatgagagatgattctcgttctgctctcttttttgggcgttaatcgggccggagccaaagtccgctctttcaaaaatatgaattttttataaatcgatctcaatatgttgtgtttttctgagaggttagtatactatatatagtgttaagagattcattatttttgataggtcgtgataaggatggttcaaatcatatttgattcaaagacagggaatgttcagcgttttgtgaataaaacagactttcagctgatccgcaaggtggacgaaacggaccacgtggacactccgtttgttttggtcacctacacgacaaacttcggtcaggtaccggcatcaacacaatcatttctcgaaaaatacgcccatctcttattaggagtcgctgcgagcggcaacaaagtatggggcgataactttgcaaaaagcgccgataccatctctagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaacaagatggaaaattccagtttgataaagataaagaggctgtacatagctattttgtagactatatcaatcaaaacacagttttctttcacgatttaaaagagaagctggattatttgattgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaatcgtcgcgctgttctttgcaaacggcgacactgagaaagcaaaagaatatgtgaacttgatgatcaatcaggaatatcagccaagcacaccgacatttttgaatgccggcagaaaacgccgcggagaacttgtgagctgtttcttgctcgaagtcaatgattccttaaacgatatttcacgggcgatcgatatttccatgcagctgtctaaattgggcggcggggtttctcttaatctgtccaagctccgcgcgaaaggtgaagcgattaaagatgttgagaatgccacaaaaggcgttgtaggcgtcatgaagcttcttgataacgcgttccgttacgctgaccaaatggggcaaagacaaggctctggcgcggcgtacttaaacattttccaccgcgatatcaatgactttcttgatacgaaaaagatttctgcggatgaagatgtgcgtgtcaaaacgctttctatcggtgtcgtcattccggataagttcgttgagcttgcacgtgaggacaaagcggcttatgtattctatccgcacacgatttataaagaatacggccagcatatggatgagatggacatgacggcgatgtatgaggaacttgtcgacaacccgcgtgtcaaaaaagaaaaagtgaatgcgcgcaaattgcttgaaaagcttgccgttctccgttctgagtcaggttatccatacattatgttccaggacaacgtaaacaaagagcatgcgaataaccacgtatcaaaagtgaaattctcgaacctttgctctgaagtgcttcaggcgtcacaggtttcggcttacacagattatgacgaggaagacgaaatcggcttggacatttcctgcaaccttggttcattaaatatactgaatgtcatgaaacataaatcgattgagcgcacggtgaaactcgcgacggattccctgactcatgtatctgagacgacggatatccgcaacgcgccggcagtcagacgcgcgaacaaagcgatgaagtcgatcggtttaggcgccatgaaccttcacggctacctggcccaaaacggcatcgcttatgaaagcccggaagcaagagatttcgcgaatacgttctttatgatggtgaacttttattccatccagcgttcagctgagcttgcgaaagaaaaaggcgaaacgtttgagcattatgaaggctccacttatgcaacgggagaatatttcaataaatacatcgaaaaagagttctcaccggcatacgaaaaaatcgctgcgctctttgaaggcatgcacatcccgacaatcgaagactggaaagagctgaaggcgtttgtcgctgaaaacggcatgtaccacagctacagactgtgcatcgcgccgacaggctccatttcctacgtccaatccagcacggcgtccgttatgccgatcatggaacggatcgaagaaagaacatacggaaattcaaaaacgtattacccgatgccggggttagcgtctaataactggttcttctacaaagaagcttatgatatggacatgttcaaagtggtggatatgatcgcgacaatccagcagcatatcgatcagggaatcagctttaccctgtttttgaaagatacgatgacaactcgtgatctgaaccgtattgatctgtatgcccaccatagaggcatcaaaaccatttactatgcaagaacgaaagataccgggcaggacagctgtctttcttgtgtcgtttgattaaaggagagttaacagtgacaaaaatttatgacgcagcaaactggtcaaagcatgaagatgatttcacccaaatgttttacaaccaaaacgtaaagcagttttggcttccggaagagatcgcattaaacggcgatcttcttacttggaagtatttgggtaaaaatgagcaggatacgtacatgaaggtgctcgccggcctgacactgcttgatacagagcaggggaacacaggcatgccgattgtggccgagcacgtcgagggccatcagcgaaaagcggttcttaatttcatggcgatgatggaaaacgcggtgcacgcaaaatcatattcaaatatttttatgacgcttgctccgactgaaacgatcaacgaagtatttgaatgggttaaacaaaataaatatttgcagaaaaaagcgcaaatgattgtcgggctttacaaagccattcaaaaagatgatgaaatttcactgtttaaagcgatggtcgcatcggtttacttagaaagcttccttttctacagcggtttctattatccgttatatttctacggacagggaaaactgatgcaaagcggtgagatcatcaacctgattcttcgtgatgaagcgatccacggtgtatatgtcggactgctggcacaggaaatatacaataaacaaacagaagcgaaaaaagcggaacttcgcgaatttgcggttgagcttttagaagagctttatcacaatgagcttgaatatacagaggatctctacgaccaagtcgggctgtctcatgacgtaaagaaattcatccgctataacgccaataaagctttgatgaacttagggttcgatccttactttgaagaagaggatattaatccgatcgtattaaacggattaaacaccaaaacaaaatcacatgatttcttctccatgaaagggaacggctacaaaaaggcgaccgtagaaccgattaaggacgaagatttttattttggccaagacgaagagcagatataatatctgctcttttggcttgaatggagaggtaagacaggaggaacgggcatgaataaaatggatgaaatcatcttggctgcaccgcggagtgacgtctttcaaaacgaaatgctgacatttcagggagtcaacagcgaggatgaacgtatcataaaaattatggctcaaattgaggcgcatttttttgaaatcagaagaggcgacgcggaagaggacccgcgatttaaacagccgattccgtatgtcgtcatccgccgtgatgatgaggtgtttgtgtatgagcggctcgcgggcggaggggaatcgcgcctccataataagctttctctcggcttcggcggacacatgaaccctatggaaggggcggcttcattttcggaagtgctgaaacagaacaccgaccgggagctggcggaagaactgtacattcgcgaggaggacaaacaaaacattgtcacactcggcttgatcaatgatgatgaaaacgatgtagggaaggtgcatatcggcatcctttctgcgctccagttagcgcctgcagcacaagtcgaagtgaaagaaaaagatcaaatcgccgggcgctggatgaaactgagcgaactgaaagaggaaaatgtgtatcagcgtcttgaagcttggtctcagtttgtcgccgatatacttcaataacaaaaaacccccgttcgtcccaaaaaagggagagcaggggttttttcgtttagtcttgcacaatgaaggcatcaaatccggctttttcggcccgcgctgccaacgcttcagcataatctctgaaagagaatgcgccgatctgcactttaaataagccgccttttggaagcacaatcgcgtcaaaacctttagacaccgcatcggcggcaagcgcatcagcatttgctttcacgttgaatgcgccgatttgcactttatataagtcagcctttttttttagaccgaaagcttgctccaagcccttggcatgtcctcttgcaaggctttcaataaaactggctgttttcagtttgtttgcatcagctgacgtatcaacaaaaccattctccgtcaaaatcgccggcatccttgtctcccgcagcacatggaagttggctgttttttttccgcggtcattaaaacccgatgcttgaattacttgcgtgtggacggctgattggtaagtcgaggtcggcgctccgacaccggggtaaatatagctttcgaatccggttccgcctcctgagttaatatgaatggataaaaaataatctgcgccccagctgttggcggcatccgttctttccgtcaggctgaccgtcttatcgcttgtcctgctcatcgtgacagaaactccttcatactcattcgtcagaatcgtgcgcaaagccagtgcgatctccagcgtgaccgctttttcctgaagtccgtttccggttgcacctgaatcagttccgccatgaccggggtctataaaaattttaaccattctccatcacctcattacagcatatgatgatgttcaaaaggtgcttgtacggctgtcattcatgaaaaaaatgagagatacacccaacatttcccggaaaataaaaataaatggtttgtcctcccgtttctgctgaatacaataagaaatgaaaaatatttctcgggaaagcgcaggattcaacatcattcccgaagagaacggaaaaagtgacagataaagaggaaaacgggcctcatgatgataggcggatgtcaccgaacctcttcatcatgagtaagataaagagagaacagagaggtgagcatgttggagcgcgctgtaacctataaaaataacggacaaattaacatcattcttaatggccaaaagcaagtgctgacaaatgcagaagctgaggcggaatatcaggccgccctgcaaaaaaatgaagccaagcacagcattctgaaagaaattgaaaaagaaatgaacacattagtgggtatggaagaaatgaaacgcaacattaaagaaatttacgcttggatattcgtcaaccaaaaacgggccgaacaagggctgaaagtcggaaaacaagctcttcatatgatgttcaaagggaacccaggcacagggaaaaccaccgtcgcgagactgatcggcaagcttttcttcgaaatgaacgttctttccaaaggacatctgatcgaagcggaacgtgccgatctcgtcggtgaatacatcggacacacggcgcaaaaaacgagagatctgattaaaaaatcgcttgggggtattttattcattgatgaagcatactcacttgcaaggggcggagaaaaggatttcggtaaagaggcgattgatacgcttgtcaaacatatggaagacaaacagcatgaatttattctgatcctggcagggtactcgagagaaatgacacatttcctgtcattaaatcccggcctgcaatcgcgttttcctatcagcatcgattttccggattactctgtcactcagctgatggacatcgcaaagcgcatgatagcagagcgggagtatcaattaagccaggaagccgagtggaagttaaaagattacttaatgacagtgaaaagcacgacaagccccattaaattcagcaacgggcgctttgtcagaaacgtgattgaaaaatcaatccgcgctcaggccatgagacttttaatgggagaccaatacttaaaaaacgatttaatgacgatcaagagccaggatttacttataaaagatgaggcggcagctcacgaatagacctctcagccggtttgaggggtctcttttttatttctctctttaaaacccgccggatgtgtggtatacgccctgcgggtttggtatgatagtactactgcccaatacgacacagaaaggaacatccatttgaacgaacaggaaggaaaaaaagaaacggtcattttggtcggctgccagcttccgcacatgacagatgagcactttgaacattccatggaagagcttgcttcattgacaaaaacggctgacggaacggtgctgacccggattacgcaaaaacggaacagagcggatgccgctacatacataggcaaggggaaagtagacgagctgaaggcgctgtgtgaagagcttgaagcggatctggttatttttaatgatgaactgtcaccgagccagcttaaatcactcgccactgcaattgaagcgaagatcatcgaccgcacgcagcttattttggatattttcgcaaaaagggcgaagacgagagaaggaaagcttcagatcgaattggcccagcttcaatacgcgctgccgcgtctgagcggacaaggaatcaatctctcaagacaaggcggcggaatcgggacgagagggcccggtgagacaaagcttgaaacagaccggcgccacattagaaaccgcatacacgaaattaacgtgcagctgtcaacggttatccgccacagaagccgttatcgggagagacgcaaaaagaacggcgtgcttcaggctgcactcgtcggttataccaatgcaggaaaatcaacgtggttcaatcaattaacaagctcagacagctatgaagaagatctgctgtttgcaacacttgatccgatgacgagaaagatggcgctcccaagcggctacagcgtccttttgtctgatacggtcggtttcattcaggatctgccgacgacgctgattgccgctttccgttcaacgcttgaggaagtgaaggaagcagacttgatcattcatgtcattgattcatccaatgaagattatgccgggcatgaacagactgtcctcggtctgttaaaagagcttgaggcagatgatattccggtgctgaccgcttataacaaacgtgacgagacacttcctgacttcatcccgacagcgggagaaggccacatcatgatcagcgccagaatcgccggggatgaagcaaaactaaaagcggaaatcgaagcttatttgcgccgagagctgatgatgccgtatgaagttcatgtgcctgccgccgaaggcaaattgatgtcacgcatcaaatcagagaccatgatcgacagcctttattttaatgaagaaaatgaacgctacgaagtctcaggttatgtacaggaagaacaaagcatactcggagaattgaagaaattcatgtaaggaaggtatacacaacatgtttgacacactgacccacggcgctcttttacaaaaaaccgccgaagaaacagaagcggaaatctccgccgttcataaaagaatagaagaaatcagtgaacggaatgaatggagagtcctgcaaagctacagaaaacataaagtaagcgatacgcattttacgccttcaaccggatacggttatgatgatatcggacgagatacactggagaagatctatgctgatgtgttcggaggagaggcggggcttgtgcggccgcaaatcatttccggaacgcatgcgatttcaatcgcgctcttcggtgtgctgagacccggggacgaattgctttatatcacaggcaagccttacgatacactcgaggaaatcgtcggagtaagaggcggggagtattcaggctcgcttaaggaatttcaaatcggatacaatgcagtcgatttaacatcagaaggcagagtggactttgaagcggtccgggctgcaatccaaccgaatacaaaagtggtcggcatccagcgttcaaaaggatatgcgaatcgtccgtctttcagaataaatgaaattgaagagatgattcgtttcgtaaaggaaatcaaagaagatgtcattgtttttgtggacaattgctacggagaatttgcagaagagcgggaaccctgccacgtcggagcggatcttatggccggctccctgattaaaaacccgggcggcggccttgctaaaacgggcggctatcttgtagggaaagccaagtggattgaggcctgctcttaccggatgacctccccgggaatcggaagtgaagccggggcttcgctttattcactgcaggaaatgtatcaaggtttctttctcgctccgcatgtagtggcgcaaagcttgaagggcgcggtatttaccgcctgttttcttgaaaagctcggctttacgtcaaaccctgcatggaatgcgccgagaacggatctgattcaatcagttgagtttcaggaccctgataagatgatcgctttttgccaggcgatacaatatgcttcaccgattaatgcgcatgtgacgccttatccgagctatatgccgggatatgaagacgatgtcattatggcagcgggcactttcgtacagggagcaagcattgaattatcagcagatggacctatcagaccgccttatgtcgcgtatgtccaaggaggattaacctacgcgcacgtgaaaaatgcgatttgcagcgccgtaaatgctttaatggaaaaagagctgatttaggccggttgcaattttcaaagaatttgatgttaagattcctcacattgtgttgacacaaaatataacatcacctataatgagactaagataagaaaaggaggaaattgagatgagtgataacattcgccgctcaatgcctttatttccaattggaattgtcatgcagttaacagaactttctgcccggcaaattcgatattatgaggaaaatggattgatatttccagcgagaagcgaaggaaatagacgattattttcattccatgatgtagataaactgttagaaatcaaaaatctgattgaacaaggcgtcaatatggcggggatcaaacaaattctggataaggcatctgccgaaccggaagaaaaatccgaaaaaacagccaaaccgatgaagcacaatctgtctgatgacgaactcagaaagcttctgaaaaacgaactgatgcaggcaggccgtttccagcggggaaatactttccgccaaggtgacatgtcccgattctttcattaatccgttagcaactgttttgctatatacatttaccttttagaggaggagttttacgaaatggcaaagtacacaagagaagacatcgtaaaattagtaaatgaggaaaacgtaaagtatatccgccttcaattcacagacattctcggaacgattaaaaacgtggaaattcctgtgagccagcttgaaaaagcacttgataataaatgcatgttcgacggttcttccatcgaaggtttcgtccgtatcgaagagtctgatatgtacttatatcctgatctgaacacatttgtaatcttcccatggacggctgaaaaaggtaaagtagcacgcttcatctgtgacatttacaatccggacggcacgccgttcgaaggtgacccgcgtaacaacctcaaacggattctgaaagaaatgaaagaactcggtttcagcgatttcaatcttggacctgagcctgaattcttcctgtttaaattagatgaaaaaggcgaaccgacgcttgaattgaacgataaaggcggatacttcgatctggctccgactgacttgggagaaaactgccgccgcgatatcgtgcttgagcttgaagaaatgggctttgaaatcgaagcatctcaccatgaagttgctccgggtcagcacgaaatcgattttaaatatgccggtgccatccgttcttgtgacgacatccaaactttcaaactggttgtcaaaacgatcgcccgcaaacacggtctgcatgcgacattcatgccaaaaccgctgttcggcgtaaacggttccggtatgcactgcaacctatcactctttaaagataacgttaacgcattctttgataaagacgctgatcttcagctgagtgaaacagcaaaacatttcattgccggtatcgtaaaacacgcgacaagctttacggctgtcacaaacccgacagtgaactcttacaaacgccttgttccgggctatgaagcaccttgctacgtggcatggagcgcacaaaacagaagcccgctgatccgtatcccggcttcccgcggcatcagcacgcgtgttgaagtccgcagcgtagacccggcggcaaacccgtacttggcgttaagcgtattgcttgcagcaggccttgacggaatcaaaaacaaacttgaagcaccggctccgattgaccgcaacatctacgtcatgagcaaagaagagcgcatggaaaacggcatcgtagatcttccggcgacactggcggaagctctcgacgaattcaaatcaaacgaagtcatggttgcagcgctcggcgagcacctgttcgaacacttcatcgaagcaaaagaaatcgaatgggatatgttccgcacgcaagttcacccttgggagcgcgaacagtacatgtctcagtattaatcgctcaatcccttggcactattggtgtcaggggattttttgattttgtcataagattaagaggtcgatattttggtccttgaccaaaatatgaccaaaaaaaattgaagttatgaatctaactccataattgaggccacgtattaattgtaatcccttattcggtttaggatgaaggctacatgaagccaattatgctctaaaattgaaccggccatttttattttcaaaaagcaggagcaggaaattcatcaattttgatacgaagtaaactataaggtttctgtcgtaagtcttctccataatgaaatctagcctgccgatgtaattggttcacgatgacgtataagtatccatccggaccaatcgaaaaagtatccggccataaaattatcggatcatgtgcgatcgtttccattgtgccattcggcagcatctttcgaatactattgttctcataatctccggcataaacggctccttttgcatctgtaatcattccatcagacgcgcctttttctccccaatacgccacataataaagtaaatccatgtccgatatatttctatctctcagggcttctgttgagatagagaacaaatggcggctggtcaggggacaaaaaaataatacctttccgtcaggagagatcgcaataccgtcggatgccagcctaaatggggaagttgaaccatccctgttacgattcatcaaaattttgccttctactttcggtataaaagaggaatccggtgaagttggatttgctccatttaaccgtctaaatgcgtttccggtttctaaatcaacgacgataatagctcctggtcctttggaagaagaatccgttatataggcataacctgcagttccaacacgaaaatcaaatcggacatcattcaggtaagttgttggaaggacaacatcttctgtaaaggtatacactcttctgattgtattggtttttaaatcaacagcgactaattttgccccgcctttaattggttcagaaaaattgggcgccgctgtatctagtatccaaagcgttcctcttccatcagcaactacactttggacactgatgaaagtcattttgatattctcagggttaaccaaattggtttgtaaatcaggataaggctgcaatttatccccaattatttccgcaaccgtaaatttaacatcgtctccccatttcggaaaacaaatgaatatacgaccggtttctgagacagtaacaccggtaggcatagctccataaaatgcataaaccagttctaaatcaccaaaatatttttcaaaaggcagcataggtttcataatatcctcctcaaccaattaaacgggatatcacttatatatgattcgcattttttcaagtgcatgtttcttaataagttttactaaacaaaagatgatggaagtgcttatcatttaataaatcagtcaggtgacacatggggtttttacttaacgtctgtcgaagcagccggcaattacaacatggtacgtcctttggtcggttttaaattctctgaaaaaagagttgaaaaagcagaaaagattttataatatgaaatcaagttagtttgttcgatcaacaaactaataaaaccactttaattgcccatcatgtaaaggtcttaaatgggagggggataagaggctcgatttaattggaggtatataaaaagtgaaagccaagcttttatcctgttcactatgatgaaaatgctctgtgaaagtaaatcgctatcatttttttgaaagcgcttttataaagccttcactggccgataaaattgaagaaatgttataccatttcataatgttccttatgtaaaggatcgaaaaggggaggaaatcatgctcagtgaaaatgtaaagaagatcagcatggttgaaaaagttggatatgcgtctggagattttgcatgtaatttaatttatgcaacagtgtctacttatcttttgttcttctatacagatatatttggtttaccggcagcaacagccggtacgatgtttttagtggttagaatcatcgacgctctcgctgatccttttatcggaacaatagttgacagaacaaatagcaggtttgggcgcttcagaccgtatcttttattcggagcttttccatttgtcatattggcaatactctgttttacaaccccggatttttcggatatggggaaattaatatatgcttatatcacctatgtcggcttgtcgcttacatacacaatgataaacgtgccatatggcgcgttaacatctgcaatgacccgaaataatcaagaagttgttagtataacgtctgtccgtatgttatttgcgaatcttgggggacttgtcgttgcattttttgttcccttactggctgcttatttaagcgatactttcggcagcgaatctcttggctggcagctaaccatgggtattatgggagttataggcgggtgccttttaatcttttgttttaaaagcacaaaagagcgtgtcacgcttcaaaaatctgaagaaaaaattaaattatcggatatatttgagcaatttcgtgttaatcggcctctagttgtattaagtattttctttattattatttttggagtgaattcaatcagtaattcggttggcatctattacgtaacgtataatttagaaagagcggatttagtgaagtggtacggtttgttgggaagtttgcctgctttggtcattttaccgtttataccaaagcttcatcaattattagggaagaagaaattactaaattatgcattattactgaatatgatcggcctcttagctttactgttcgttccgtcaagtaatatattcctgatactttcctttcgattgctggctgctgccggaagtctcactgccgggggctatatgtgggcgcttatacctgaaacaatcgaatatggagagtataagaccgggaaaagaatgggcggtctcatatacgctattatcggatttttctttaaattcggcatggccttgggaggggttgtaccgggtttggttttagatcagtttggatatgtggcaaatcaggtgcaaacgccggaggcattgacgggaattttaattacagcaaccattattcccgtgttcttactggttctggccatgattgatattaatttctataacttagatgagaaaaaatataaaaacatggtgcgagaattagagaatagagacaaagtttatttggatcatattgacgatttcaaagcttaaaacatgatgagtcaacagaaaatagctgaggaggcgttctgcatgaagattatcaatccagtacttaaaggattcaaccccgatccgagtatttgcagggttggagaggattattatatcgctgtatctacatttgagtggtttccgggagtccagatacaccactcaaaagatttagtcaattggcacttagttgcacatccattacagagagtttcgcaattagacatgaaaggaaatcctaattcaggcggggtctgggcgccatgtttaagttacagtgacggaaagttttggctgatctatacggatgttaaggtcgtagatggcgcctggaaagattgccacaattatttagtgacttgtgacacgattgatggtgattggggggagccgatcacattaaacagctcgggttttgatgcttctttattccatgatacggatgggaaaaaatatttattaaatatgttatgggatcagcgtattgatcggcactcctttggaggcattgtcatgcaggaatattctgataaggagcaaaaactgatcggtaaaccgaaagtgatatttaaaggaactgaaagaaagctgacggaagcgccgcatctttatcatatcgggaactattattatttattaaccgcagaaggaggaacgcggttcgaacatgctgctacaattgcccgttctgcgaatattgaggggccatatgaagttcatcctgataacccaatcttaacgtcatggcatgatccaggaaacccattgcaaaaatgcgggcatgcatctattgttcacacacatacagatgagtggtatttagctcatttaacgggacgtcccattcatctggacgatgattcaatttttcagcagagaggatattgtcctttgggcagagaaacagctattcaaaagctctattggaaagatggctggccttatgtagaaggcggaaaagaagggagcttggaagtggatgcaccttctatacctgaaacaatgtttgaagacacgtatccggaagttgatgaatttgaggatgcagcattaaatattaattttcaaacattaagaatcccttttacggagaaattaggttcattaactcaagcgccaaatcatttacgattatacggccatgaatccttaacttcgacgtttactcaggcatttgtagccagacgctggcaaagtctccattttgaagcggaaacggctgttgcgttttatccggaaaattttcagcaagccgctggtttggtgaactattacaatacagagaactggacggctcttcaagtcacgcatgatgaagaacttggccgtattcttgatttaacgatatgtgataacttttctttttcacaaccgttaaaaaataaaattgtaattccccgtgaagtcaagtacgtctatttaaaagtgaatattgaaaacgaaaaatattattatttctattcatttaacaaagaagattggcacaaaatcgacattgcattggaatcgaaaaaattatcagatgattatatccgaggcgggggattctttacaggagcttttgtagggatgcaatgccaagatacgagcggaaatcaaattccggccgacttcagatatttccgttataaagaaaaatgaatgtccgcatgaaaaaggagctttctattttggaactcctttttcatattagaatgtgcctgtgtggaaaaacacgtcagatatgctcccattcaggatgaaaataacaaaacaaaaaacccatctttaaagatgagcgtaaaacatagaagtttatacatttcagttatgaaccatgtcgagaaaatgatcaatcacaatagaggacattcctaaagcgggtgcattttttcctaagaaagatggtaatagttcatagctattgtctaggtgggaataaacccttgacgacacttcacttctcattgaatttaaaaccataggatgcgattcaattatgctatttcttaaaattacggcctgtgggttgaaagtatttaaaatattggtaaggcctattcctaaatagaatccaaaattctgtaatgcgtttaaggttccgatatcattcagatgggcgaggtctatgatatcttgataggacagttttttctctttggtctgaagagattttaataaagccttctctgaagcatacaattcccagcagcctcggtttccgcaactgcatttaggaccattaaagtctattgtcatatgtcccatttctccagagaagccgcttactcctctatataaatgattgttgataataacaccgatccctatccctgtgctgatacttacgtaaataatgttatcgtgattttttgcagctccaaatactttctctccatatgcgccagcgtttgcctcattttcaataaaaacaggcacattgtacttctcttgtatcgaagattttaagtcaatatctctccagttggagttcggagtgaaaacaattttttgatctttatcaatgagtccaggcacgcaaatacctataccaataagcccgtacggagattggggcatatgcgtaataaagtgatgaatcatatcaatcaaaatgtctttcgttatttctggagaattggattccaaatggcagtattgatcaagaacgatcgttccttcaaggtctgttaaaatgccattgatataatccacaccaacatctattcctacggagtatcctgcctttttattaaaaacaagcatgactggtcttctgccgccgcttgattgtccctgacctatttcaaatacgaggttttctttcattaatgtgtttacctgtgacgaaacagttgatttatttaatccggtcatttcagataattttgctcttgaaataggagaattcttaagtatttcgtttagtaataacttttggttaacttttttgacaaaggcttgatcagcgatatccacttcatccactccatttgtataatctttaaattaagttgaacgttctgtgttatcgtgcgaaacgcagtacatagcgaatgcaacctttattatatctaatgtgttcgtaaaaaactaaaaaaaatattgaaaatactgatgaggttatataagatgaaaataagttagtttgtttaggcaacaaactaatatataacatgacataaaagcatctgtatttgaatgatcatgtttagaatttatttttaagggggaaatcacacatggctcactctcattccggttcagtcggctattttgaaagcgtaaacaaagtgatttacgaagggaaagattccactaatcctttagcatttaaatattataatcctcaagaagtaatcggcgaaaagacaatgaaagagcatctgcgattttctattgcctattggcatacatttaccgctgacggcacagacatgtttggcgcagctacgatgcagagaccgtgggatcactataaaggcatggatctggcgagagcgagggtagatgcagcgtttgagatgtttgaaaaactggatgcgccattttttgcttttcatgaccgggatatcgcaccggaaggaagtacgttaaaagagacaaatcaaaatctggatataatcgtggacatgataaaagactacatgagaaccagcagcgttaagcttttatggaatactgcaaatatgttcacgaatccccgttttgtgcatggtgcggcgacttcttgtaatgcagatgtatttgcgtatgccgcagcccaagtaaaaaaaggattagaaacagcaaaagagcttggcgccgagaactatgtattttggggcggacgtgaagggtacgaaactttgttaaataccgatttaaaatttgagcttgataatatggccagatttatgcatatggcagtggattatgcgaaggaaatcgggtatacagggcagtttttgattgaaccaaaaccaaaagagccgaccacccatcaatatgatacggacgcagcaacaaccattgcctttttaaagcaatacggcttagacaatcattttaaattaaatctcgaagccaatcatgccacattagccgggcatacattcgaacatgaattacgcatggcgagagtgcatggccttctcggctctgttgacgcgaatcagggtgatccgcttttaggctgggacacagatgaatttccgacagatttatattctgcgacattagcaatgtacgaaatcctgcaaaatggcggtcttggaagcggaggattaaactttgacgcaaaggtcaggagatcttcttttgagcctgatgatttactatatgcccatgttgcagggatggatacatttgcaagaggattgaaagccgcacacaagttaatcgaagatcgtgtgtttgaagatgtgattcaacaccgttaccgcagctttactgaagggattggccttgaaattgcagaaggaagagctaatttcaagacgcttgagcaatatgcgctgaacaatcagccaattaaaaacgaatcagggagacaggaacggttaaaagcgatattaaaccaatacattttacaggtataacaaatgaaaaaagaagttccagatcccgctgtaaaaagatgcaggcagccaagttcccaattgcccgtcatgaagttactgttatggcgggtcatttcaatggggatctatttagagaggaaggagtgaaaaaatgaagtatgtcattggaatagaccttggaacgagtgccgttaaaaccattttagtcaatcaaaacggcaaggtttgtgcagaagcgtccaaaagttatccgctcatccaagagaaggcgggatatagtgagcaaaatcctgaagactgggtgcagcaaacaattgaagcattggctgaattgatttcgatatccaacgtccaatctggggatattgacgggattagctattcaggacaaatgcatgggttagtactgcttgaccaagatcggcaggtgctgcgtcatgcgattctttggaatgatactagaacgacgcctcaatgcagcaggataaccgagacatttggcgatcatctgcttgatatcacaaaaaatcgtgtccttgaagggtttacattacctaaaatgttatgggtgaaggaacatgagcctgaactttttaacaaaaccgctgtttttctgcttccgaaagactatgtgagattccgcatgaccggcgccgttcacaccgaatactccgatgcggcaggaacgttacttttacatatgacccgcaaagagtggagcgatgagatttgcaatcaatttggtatttcagcagaaatttgtcctccgctggttgaatcccatgactgtgtaggatcgctgcttccgagcgttgcggcgaagacagggctgctcgaaaaaacaaaagtatacgctgggggagcagataatgcttgcggtgctgtcggagccggtattctttcttcgggaaaaacattatgcagtatcgggacgtcaggagtcatactttcctgtgaagaagacaaagaaagggactttaaagggaaagtgcacttttttaatcatggaaagaaggattctttttatacgatgggagtcacgctcgctgcagggtacagcttggactggtttaaaagaacgtttgcgccgaacgaatcgtttgaacaattattgcagggcgtggaatctgttccgataggagcaaatggactgctgtacactccttacttggtcggtgaaagaacgccgcatgctgattcatctattcggggaagcttgatcggaatggacggagcccataaaagagagcactttttgagggcgataatggaaggcatcacattctctttatatgaatcaattgagctattccgcgaagcgggaaaatcagttgatacggttgtctctattggcgggggagctaaaaatgaaacgtggcttcaaatgcaggctgatattttcaatacgagggtggttaagttagaaaatgaacaaggtccggccatgggggctgcgatgttagccgccttcggaagcgggtggtttgactctcttgaagaatgtgcagagcagttcattcatgaagcagctgcattttatccaaaagaacaaaatgttcaaaaatataaaacattattcgagttgtataagaacatttacgctcacacaaaagatctcaatacagctttaaagagctttcgacaaacctaattttcaggaggtcagttgagggatatcaaagcaacggcagcgctaatgtaacttcaaatgtgttagctattgaaggaaactgataagcattcttgtaagttgtgactgcatcagtctaaactcatatgacgatgaattgagaagtatacacacaaaacatcccctcacattgcgtgagggggatgttttttattattgagattttcctgtttcttgaatccgtggagatagcctttctgcaatggattcgcaggtattactcaacttcaggagttccttagaaaatgaagaaagaacctcgccaaattggccaggttctttttatattgcacaaaaacagacacggtgatataatcagaacacgcgcgctttctgtgtgaaaagtcatagttatccatcttatattatgattatatcatgctgaaaagctcttgtcaaatttttttgaaggggagatatagaatgagttctttggttctcggcattcacgaaattgaaaaaacacagcctttgctcattggaggaaaagggttacatttaggggaattatcaaaaattcaaggaatacaagtaccggaaggattttgtgtcacaaccgcaggatatcgaaaagccattgaacaaaacgaaacgttacaagcgctgttgggtcaactgaccatgctgaaagcggagaatcgggatcaaattggtgaagtcagcaaaaaaatccggcaaaccattatggaagcagaaattccttcagatgtagtcaaagcagttgcttgctatctctcccgatttggcgaaaaacatgcctatgccgtacgttccagtgcgacagctgaggatttaccgcatgcctctttcgccggtcaacaagacacctatttaaatattaccggcgtcgatgcgatcttgcagcatatcagtaaatgttgggcgtccctatttacggatcgcgcggtcatttaccgtatgcaaaatggatttgatcacagccaagtttatttatccgttatcatccaaaggatggtgttccctcaggcttcggggattttatttaccgctgatccgatgaccggaaaccgaaagctgctatccattgatgccggttttggacttggtgaagcactggtctccggcttagtctctgccgattgttataaagtacaggacgggcaaatcgtcgataagagaatagaaactaaaaaattggctatctatggacgaaaagaaggcggaacggaaacacgggagattgatcttgatcagcaaaagattcaaacactgactgatgaacaaattttacagctggcacgtatcgggagacagatcgaagctcatttcggccagccgcaagatatcgaatggtgtttggaccgcgatactttttatattgtccaaagtcgtccgatcacaacgttataccccgttcctgaagcgaacgatcaagaaaatcacgtctatatctctgtcggtcatcagcaaatgatgacggatcccataaaaccccttggattgtctttttttctgttgacgactgctgcacccatgcgtaaagccggcggaaggctattcgttgatgtcacacatcaactggcatcccctaatgtcagagaagttttcttaaaaggcatggggcagcacgatccgctcttaaaagacgcacttatgaccataatagagcggcatgatttcattaagccgatacatgataaaacggcgccgattcccggcaaaggcaatgcagatatgccggatcaagctgaaaacgatccggcaattgtttctgatttgattaagagcagtcaggcatcgatagaagagctaaaacaaaacatccagacgaaatcaggatctgatttatttcgttttattttggaagatatccaggaattaaagaatattttatttaatccaaaaagttcggtattgattcgaactgcaatggatgcttcatcatggattaacgaaaaaatgaacgagtggttaggtgaaaaaaacgcagcagatacgctttctcaatctgtacctcataatattacttcagaaatggggcttgtgctattggacgtcgccgatgtgatccgtccttatccagaagtaattgcctatttagagaatgtaaaagatgatcactttttggatgggctggtgaagtttgaaggcgggcgggaaacccatgacgctatctatgcttatctcaacaagtacggaatgcgatgtgccggagaaattgatatcacaagaactcgatggagcgaaaaaccaattgcacttgtccctatgattcttaataatctcaaaaactttgagtcaaatgccagccagcggaaatttgagcaagggcggcaggaggcgttgaagaaagaacaagagttattagaccgattgaagcaattaccggacggtgaacaaaaagccagagaaactaaacgaatgatccaaatcatccggaacttcagcgggttcagagaatatccaaaatatggcatgatcagccgctacttcgtttataaacaggctttactgaaagaagccgaacaactcgcaaaagcggggttattcatgaaaaagaagacatatactatctcacttttgaagaacttcaggaagtcgtacgcacaaataaattggattaccaaatcatcagcacacgaaaaggcgagtacaaagtatatgaaaaactatctccgccgcgtgttatcacgtctgacggtgaaatcgttacaggcgagtacaaacgagaaaatctcccggccggagcgattgcagggctgcccgtttcctcgggagtcatagagggccgggcacgggttattttaaacatggaagatgccgatttggaagatggagatatattagttacctcctatactgatcccagctggacaccattgtttgtatccataaaaggcctggtcactgaagttggcggactgatgacccatggagcggttatcgcgcgtgaatacggcttacctgcagttgttggagttgaaaatgcaacccaattgataaaagatgggcagcgaatccgcgttcatggaacagaaggctctattgaaatattataatagcgggtgtgtgcagcacgtcaccagctatttcccgcattttaactgacaaagaccgaacaaaaagaaaagccggaacctcttagaagaggaatccggtttttttatgtgaaaatgacttaatgtgtgaacaccgtattttgtgggcggaccctttttaaatgagtgtggaaggccgctaagataccaaacaaaaaagattcagtgactaaatctaacgaatgacaattttataaaggtgagtaatatcctttttaagttcacaacatctgtaatcctgatgaattaaaaaccgccttagttttttaacaactatttaggggttttgttcatgaacaagtctttattccgaattggattgttcgctttattcttcatagcggcaatattggcgcaggcaggggaggaaactctcccgcttaccagagtaaaaataaaaaatgtttatcttagatagattttttaaaaagtaaaaacgccataaaacttcttatggcgtctgtccgaactaagggatgcaatgtttgggagacgaatataaatcgtcaatgtgctagaaaaggaatgcagcacctacaatgattaacaaaatgaacagcacaacgatcaatacgaaagaacttccaccgtaatttccaccgtagttccccatattattgccacctcctgttgttaggatagtacataatatgccggatgataaatttcgacatagatttaagtctaaataagaaaaaatggatattaagtctaaaatgaagagcttctaaaaatatgaaataatgggaagttaactgaaagagagaaatggatgggacggtttgctgtttaaagaggagggatatggcacaacatgccataaaactgtgtatgaaagtggtgagccatgaagttgcttcatcatgcagagccacatacgaagaggtacagggaaatcatagttaacgaaaatattcatcatttcccgggcaagcgcagtatacgacaaatcaaaacaaatcacaaagggacgcaaggtacgatacaaggaggctgcttgagggtttgtgatgccgataaagtttccgtttcaaaacggtcatatgtttattcgacactttacctttattcctgcagaatgattgtaaaagaaagtcccgcaaaactgccgactttcctaacggaatttagatctcaacagatctaaagaaaccatcgacactatcaccggtgccgctatcatatttcaggatgtattctcctttttggttaacgctgaattcttgaatgaacgttttccccgcatttaatgtcgtagaggatataaggaagaagctgcctgattgagtgaggtataacgatgaccggggcggctgcggatcaactgaaacgaagtatattcccaagcaaggagtatttctttaacctgaaacttttataaagctttaacgtattactttataaaggtaaataaggaggcttctgaatgggattaaaaaatttctttaatactgagttaaaatgctctatctgcggaaaaacattaaaatcaggggatgagataacagcttatcttacacttccaagtgagaagaaaatgcctgtggggagaatggacaaagtgttaagcaaacactctgataaggtctgctgtaaaaagtgcagtgagtaggtttttagtgttatgaggaacctctggtgggtttcctcataacagctacgcttcggcaatgaatgaccttgctttatattggtatcagggttagttcaggcagtacttgcaaaatgaataaccgccgaatggtctgtaaagtttcttttctgaactaaatgacaaagtcttattcagtctgggttgggcgctgagcaagaatagagattaaaggctgccgtatcattcccggcagccttaatgattaggaagtaaaatcgataaccatgcggccggtcactttaccttgctccatttcttcaaaaatatcattcacatcttcgatcgggcgttttgtcactttaggtacaactttaccgtccgcagcaaattgaaaagcttccttcaggtcttctctggtacctactaatgaacctactacctgaattccatctaacacgagacggggaatatctaaatccattttgtccaccggtaaaccgactgcgactacacgggctcctgcttttacaacatcaatcgcttgattgaaaggggttttagagacagccgtgatgaccacagcatcaagccctaaatcgttagtcacttcttttaccttagcgacggggtcttcgtttaaactgtttacaaccgcatcagcgcctaagctcttagcaaaattcaatttttcatcactaatgtcgaaagcaatcactttagcgttaaagacgttttttgcatattgaacagccaagttgcctaaaccgccgactccaaatacaccgatccattgacctggtttaatttcactgactttaaccgctttataagttgttacacctgcacaagtaatgctgcttgctgctgcaggatctaaattttccggcacctttattgcataatcaaccgctacgattgcttcttcagccattgcgccgtcaactgtatagccggcattttttacatcccggcacaaggtttcccggccagttaagcaatattcacagcagccgcagctttcaaacatccaggcaatagagacgcggtcaccttttttcaggcttgttacgccttcaccaatctcagtcacaatgcctattccctcatgacctaaagtgacgccagtaacatccccgaaatcagcatttttaacatgcaagtcagtatgacatacaccgcagtattccatcttaactttggcttcaccatgtcgcaaaggacgtaattctttttgtacgatcgctatacttttgtcttttgttgctactacagctttcaaatcatacacccctttcaaatattagcagaaaatttttacttatcttacaatttagcatactgctcttattttgaaaacccttacatttttgcgggcaagtgcctctacaaaaattgagggagctatgaagggaggattctacggatgatttgtcatccgaatggtgtttaaatgggggtttgtctccaaatgcacagaatgctttgcttttgtggtcataatctttctatagatatttgacttgcactgcagagaattacactggcaggatatgattttacctttagtgaaaagaatttcacgggtaatcatttgaacttgagctcggctgataaggtgaatggtgatgcaaacagaaatcattacttattgattacaaaagaagcaggctgcggagacgtgtggatttcacggattcgaacacgatgagccggatgcagattggtgagcgatacacagtcaaggtatttccttgaccttttttatgggtatactgataattaaaagtaatcatagtatactaaagttacaataaaagtaacgaaatacaaattttaaggagttgcataaaatcattcttttaaagagaaggggatcaggttggatcagttaataaatcctacgaaacattctttttattttaggctaagtaaacatgactgttataaagttagaacaggaaagtgctccttagatttaactgataaggaatttaatgctttagaaggcgaagagcatgaatatgcattaaaatgcagaagattggctgcgcactacataaaaccggacatgcataaaaaacattcaggaatatatgcaagcgtaaatgcttgcggtcatatttcgtttagtgatggtcagcacaggatgtgtatctgcaaaaggtcaggtgtcgataaattacttattcatttatcaaacaacggagattatatatgtcatatatgccaggacaaaaacaaaaaattaacagttaaagaaaaattgaagcaaaggttttttaaaaaggattcgaataaacttgcaagagaaaatgattttattgatgatgagttttttgattaaaccaatcttttatttcaaatggaggggtacatttgggtatactcaactttttcaagaacaaagttaaaaatgaacaaaatgagaataaaaataataatatgaacactgttggcgttaataacgaaacagagatggtatcgaaaaaagaaaatttcccaatcttgattcaagagacaggcttctcaaggaaatatgaagaaaagtctgcatttttcgagtatatagactttaaggttgcaggaacatcacactatcaaaaagatattaagaaagccatcaagactgaggatgaagacagctttttcttcgatgaaaaatatgatggtatgacaaataaagagattctagaatcaacttttgatgagccgatatttatttatcataattcccttttctcaaattgtgaattgcggttagaagagaacaacaagtacgatccggaagctatagctgtctatgtaaatgattgcaaagtaggacatgttcctcgaaagaattttcaagaaggcaagaaatacatttacgatcagttaaagagtggtataaggcacccgatatcagcaagtttgtatggggggaaatataaagttaaccgcgatgatacaaagattgaaacaggagaaacagattataaaattgaatgtcaaatagtgattaaaacagacaaatagacaataaaactacgatattgtaagtgcgaagtaaatgaacggggcggtgacttgaagctgaattcaacaagattaaagagctatacctacacattggctttttcaagtttgtcgtatggtttgattttcgggctatatatgtttgtatactcgggttttgtgccaattgcattagttactgtagttatcattgctttttacgcattgattacttactttttgtttgctgttcctgtgcaactatggctaagaaagaagcctaaaaagtttagtttggttcatcttttcatttataccgcagtcgcttttttagctgtgttcttgttctggcacataggtaatccgtcaattgatttcacggttttcagaagtttcatttattacataaagagcattgctgctgcgttcatatattggttctgggactctatatttctgagaaattacaatgttcaccggaagtaaagctgatgttcccaaaagaaagcgggtgaggaaaaatggaatacattgagttgactagggacaatattgatgacaatcatatttgctgtgcgttaggtacgaaacaatatgaggatgcggtaaatgaaaagaagagctggctcaaagatcggatgagtgatggcttggtgttctaccgcctaaacgaacgggccaaagtttttattgaatatttacctgcagaagaagcgtgggtcccggtaagtgtacctaattttatgtttattaattgcctttgggtctcaggtaaatataagaataacggacatgcgaaacacttgttagaaaaatgtgtgtcagatgcaaaatcccgcggtatggatgggatagttcatatagtggggaagaaaaaactcccttatttaagtgataagcatttcttcgagcatatgggatttgctgtgcaagatgaagcagaaccctattttcagttggtgtcactgacgtggaaggaacatgcacatcctcctgtatttaaaaaacaggtgaaaagtaattccgttaatgatgagggaatcataatattttatacagctcaatgcccatttgcagtcggagtgttaaaggatttaaaggaactgactgaaaagaaagggcttcattttcaggccctgagaataacgtcaaaagatatggcgcaaaaatccccggcagtttggacgactttcagcgtgttttataatgggacatttctcactcatgagatgatgagcgtaaataagtttgaaaaaatactgaataagcttttaatggcttaactttgttttattactattgctcgtttctatattcgatactgagggtttttcaggaaaattgttcagtactttacattgcgggcggcaaatgaatgattattgtttttgataaagatgataacacccatcattatagtaaaaatagattgtgataagttcttcaacaaacgaagaagttcttttcaaaggtcgataacaatgaaacaggagactgcaaatgcaaaaaattgaaacccatcgcttaattttaagaaattttaccgagaaagatgcgcaaggtctgttggaatattcggcacatccgagagtgaattgctttcttgatgacagaatatctacgttagaagaagctgccgtaaacgttcaaaaaagaagccgagatgactcttatattgcagtttgtttaaaagacagtaatgatctagtcggagaactattttatttaaaagaagagccagatacctattccgtttgttggaattttaatgcccgttttgaagggatgggatacgcaagtgaaagtgcgaaggctttctttgagtatctctttatgcaaaaagaagcaagaaggctttatgcatatgttgaagatgataactgcaggtcacaaaaactatgtgagagattaggaatgcgtaaagaaggttattttcttgaatttatttcatttactgcacacgaggatggaacacctaaatatgaaaacacataccaatacgcattgctaaagaaagaatggttaaaacaaaaacatagttaatagaatttgtggggaaataacctctcctttactgaaaaaaccctgctgaaagcaggtttttttgtatttaggttacctagtaacgatcaaaaagattcagcttgaaggttgggaaaaacatgaaaatcattatagcaatgttgtaaaattatagagaggagattgtgatggacattttgcagtttagcgacagaaggtgcaggaagtaattcgaatcagcaatgttcaattcattttgatgcatttaaagaagcgcttgagaatggaaaagtggttgatactcaaaatgtgaaaagcagttcagagtcaagacctattttacggtgagaccggaaatattctcttcatcttctgatgctgttcaaagctgacacctcttgatgcttatgtataagaaaataataccattgaaatatatgtaacatcaatgaataaggttggaaacggagggttcaaagttggtgcgatcttgtgtaaaagaaaggatcaggatgaatgtgaccagcatccaccctgaccaatggggttcacagtgttctatttcattgtattccaatcggaataatattacaagggtaaaaaaagaaataatcggaatgttttcggcttcttctgtccctggagcgggaaacggaaagtgagatgtttgaatgaaaataaatgattatctgaaggaaaggtttccgactttaaaattagtgcccggcatttatcatcaatgggacgtgggaattcatttttctctcggcggcaatatgtatcaatttaatgaaagcggtgttttgaatcttgagtattttcagcttgttcatcatcaaaccgccgcacttttcaatgagctgtttgaacatagagatgacatgttccttgttgccaacgtatataagcacaaaactcaaggtaatcacgcgagaaaattaaaggtttatcagccgtttctgaagtgtaaggatgatttatatcggatccagttgaagacctgcccctgtccgtttgaagaagatgatgcagaagaatatgaaatgcagcagttttctttattatgtaaacggaaagatctgcgtattcctcaattacttaaggcagccgtccacgaagattttccgctgaagccaaggttcgggggctgttccgttgggtatcccgatgttttctttgtgaatatgacaaaagatattattttctttctgtatgatgacagagggtgtgaagtcatcgctcttgatgccggaagaatacgaaagctttatgatcaatatcacgattggattgaattggactgaaaatgaacacatgaattcgaatccgcttgtgccggctttgttcttgcctagtccggctgcatgagtataatgggcagaattgaagggcgccggaaactttttttcctcttataccggccttctgcatgttaagcttctgtatttattttgaatgaattcctatttataaaacggctgaatagaataacataaaagcttttttacacagtgcaggaggagagaaatgtgagggctgaacaccgtgattgtatggaaattggaatttattcatttgcagaattatatcccgatcctctgacagggaaaacagtcagcgcaaagcagcggatagatgaattgatgaagctggcgaaactggctgacgacgcagggcttgatgtattcggtgtaggcgagcatcatcgtcttgattatgcggtatcttcgccgccggccatcttatcagcgatttcacagatcactgaaaatattaagctgaccagtgccacgactgtattatccaccgcagatcccgtccgtttatttgaggattttgcaacgcttgatctgatttcagacggccgggcggaaatcattgcgggacggggcgcatttttagactcgtttcctctcttcggttatgacgtaggccattataaagaactgtttgaagaacacattaacctttttttaaaactaaattccggggaagaatcggttacctggaaaggacgttaccggccgccgctgcgcgaggcagaaatttctcctcggccttttcgcggaagcattccgctatggttaggtgtttcggggactccggaaagcgcagaacgagccgggcgtgcaggtgcgggtttggcattagctgtactgagcggtgatccgatgtcatctaagccgcttgttgacaaataccgagaagcggcttttaaagccggtcatcctccggaaaatgtgaaggttgccgtaaccggacatatgttcatttcaaaaacgaatgaacaggcaatacaagaattttacccgtatcattcaaattactggtctcacgttcattcatatcacgggatcgatgagcctttaacgaaggaagattttgagcgggcgtccggaaaagaaacagctttatttgtgggaagttcacagcagatcattgaaaaaatcatgcatcaatatgagttgttcgggcatcagcgatttctcgcgcaaatcgatataggaggtatgccgtttaaaaaagccgcggaaaacatcgaacgattagcagcggaagtagcaccggttatccgaaaagaaaccggcaaatccagcgaatgaagttctgagcaaaaggggcgggccggtttttggcaatcgcggattcgacaacagaatcggcccggctttttctttatgattataaaaaacaaaggggaaagcgcgaacctcattgctttttcctatcaagaaaaggaaggtcatttcatcctctatcgtgaagtgtatatactgaaaggtttttattaacaaaagagggaggatgatgcagtaatgaagggtttagtcaaagctgcagttttaactgttactcttggaattggaggcgctttctattcaagtgatgcatctgcgcacgggtatataaaagagcccgtcagcagagcgtacatgggagctttagagaaacaaacattgggctggacggccgctgcgcagaaatatggctccgtcattgataatcctcagtctgtagaagggccgaaaggatttccggctgcaggtccgccggatggaagaattgcgtctgcaaatgggggatcgggacaaattgacttcggtttagacaagcagactgcagattattgggtaaaacaaaacatccgcggcggttttaacaccttcacttggtactacacggctcctcatgcgacatcaaagtggcactattatatcaccaagaaaaactggaatccgaataaacctttgtcaagagatgaatttgaattaatcggaacggtaaaccacgacggttccaaggcagatacgaatctgactcataagatttttgtgccgactgatcgaagcgggtatcatgtcattttgggggtatgggacgttgcggatacttccaatgccttctataacgtcatcgatgtaaatcttacacaataatctatgaattactgatcggctgcatgttgattcatcggccgatctttttagttttaatgtgtgaatgaaaaggggaaaaacagcagagcgccataaacatttcatttatggcgccgtacgatcatggaggtgctgctgacatggatgcggaggtaagaggattcttaataaccgccgaggaaagaagccccaacgatgattaataaaatgaatagcaccacgattaacgcaaaggagctaccataaccacctgagaatcccatataatctcacctcctaaagaggattaatacatactatgccgaaatgaaaagtttgatagggatgctagtttactttttgaaaaaaggttatttagtctatatttcctccacatggccatccgttaaaatgagtgtaagcaggaatcgtactgcttcctgtaatagaaatggataggctcatatattgagcagttgcgaagaggatgcgcagttggcttgtttttttaaaaatgaaaatgtaacacacgctattaggattggacccttttgattcaacggaacaggctgaagaaatgattggttggtttcaagagcagtagcatgaaaaaagtggatgtgatgaggaatagagaaaaaagatgcgaaaggcataatcggaaccatgtatcaaaacggactgcctggtgatatacgcgtatactccattccgaatgggaacgtaacgatctaaacagaagaacttcaagtgttctgcggtaaataaaaaaagccgatgaaggcttaaaattgattagacgctgtaaagcattctttttgctgcgctttctgcagacggagtttgattgtaagaaacgattccgatcatcactaacaagataatgaaaaccaatatgctccacaacactatttttaaagactttgacatggcataccctcactttgaaagactttaccggggctgcgatcggagcccgcacttcaagtatagtcgttataacggtgaaaaatgtacagtatcccgttatcaaaataaaaacttgcgggcgctgccgcaagttttctctgtattaaggtctgtggaattcaatatgctgattatcacgatcgaaccatcctctgaatgcccaattgatccagcccccgtctcctttgttatcaaaggaaccgtcttcgaagacccagattccgtaagtaatgccgtcataaacggctgatccgtaaaattgaacgccgttaaagcggtcttcatattcttgatttaaattgaacaccatgacgttgtacttctgtcctgatgcgtaaaatgttgtttccatgacattttttacccagccggttcggttttgatctgacttaaccgcttcagcaatgcgatctgaaattccgagaacatctacgtttacgttcagcccggcatcaacacctgctgcttttacgttttggcctgctgtttggggtaatttactttctaacggatttgcaacgggtgaaacgtgaggcgcgtttgcgtgttcagactgactggctgctgaggcactggctgtgaaaggaattgttagagataaagctaagcatgatccgactattgttctggcgattttcatgtctatgacctcctgaggaaatttttaaaaattgttgcaaattcatggtatcgcagagaaattgaccaagcaaagagtagattttctcaaaagtcatgtcgttctatttgtgttgttttctgtaaatgaaatacttttcattaggcgaaaagggaagaaaataatagagtctttttatgtattgtgataagatgaccggattttgggtgaaaaaagcccggagaaacgccataataagaaaaacacccgggtttaccgggtgtaaaaagtgttgatatgtcaagtcagcagcattttttacattttttgcattttcttttataaacaacgatgtaatcataatcaagatgctttttatcttgtttcttcttttgtttaggctgctttggctggtgatcataatgtccgttcatacccatatccatatccatactcatattcctccttttttcatctgacggtagtattctatgacagaaagcatggatggcttggacaaatgaaacggtatgctgaaaaagaggcatctcattcggtataaaaaacaggatcatacccgcccgatagaaaagagaggagatgatcctgatattgagaccctatttgataaccgcaattgcaatgccgtaccctttttcagcactgtataaggccgtcagtttcaataccttccagccttccgcggctttagtcccggttccgttatgagccgtgatataatctcccgggctgaccgtactgtcgacccgtacgtaatgccggccgttgagtccgacaatatgccattcgtctctggccgcgcgtgcttcatagtcagcttcaagagccggactgcagtccgggttttgtttcggtacgcgtaccgtttctcctgtttcttcgtcagtcacattttcgtatatgaaaccgccgaactcatttgtcaaaaagcggctttgccatccgaagcttgcggctcctgagataaaagcggctgtttctgaaatgacgccgagcatataatctccgacgtgagccggttcaattttttcgcctttcactgtgacgatcgtcccggcgggaatcgtctggccggttacactttcaaaatattctccgtaccctgacagggaagaggtgacagctccggcgaacgtaccgtggccgcccgctgaatccagtttccatttgatggactgatgccctccggcaaccgtgtatggttcttccaatgtaatgctttctgatgacagaatcgttctggagactttgccgcctgtaatatggacattgtttgaagcggcgataaatgcccttgaaccttcagaacttgaacctccggaagagctgatgatcgcatttctgtcacccctagccgtaatatcgcctgttcccgcaataacggcgcttgtcgggttgaatgcaaaaccggagctggtcgcgagctgtgcgcctccctttaaattgacggggatctgctcataagtctgtccttttatagatgcggccgcgctgtaaccttccgcttgcaccccgagaatgacagcctgactgttaggggacgtaattccgacggaaccgccgtctccgatcattgtaccgttcataatatttacgttatattggcctccgccgattgagatgcctttaggagaagacttgtatatatcaaaatttaaaattttaacataatcggttttattagatccgccggatatattgatgtcaaccccggcttgtgtaaagccgcgtattttaatgccgttgatcgtaatattttgactgcggtattgaagagccacgactggattcccgccatagtcgtatgagggatcaccaatagctgtgaatccgtttacattaacgtttttataggcagagatgaccagcgccctcggggtcacaccgtcatagagagcattgaataccggttcaatcgcggtgcaatcggttaaagtaacatcataagccgtcgtgctttcgggatctgaggcctgatgatggccgatatgacgaatatcaaatgaacgtacatcacgatacgaaacatgaccgataatatgaacattttgagaagccggccacaggctgtgcgcctttacctcaatcccgcggatatttccgctcgtatagttatttaaaagccacacatgtttagagccgtcgtcaatttcaatgccgttcgagtttgcgctgccctcagcatgctctgtgccgcgggggtttccggaatggcagttggaaatgaaaatatattcgctgtaatgggtggtaatgccgtcgtctccggcgccgtatgccacacagttatcaatccatatataacggcagccgtctttcgtccattctgtgtcaggcaaatgatcgtaagtcggagatgtaatatctataccatgcagacccgcgttaaccgtttcaacattcttaatccagccgtattgcacattagcaaatgttaaacagctggaaaactgtcctccggggttcctgactccgcattgacgatcaggattccagtctaaagtcatgttctggacaaaaatattacggtttccattttcgtaatcatcgttagtaacgacccattcgtatgcgggagtgtcctcatgaagcttaagcacggtaatcccttgtccctcaccggaaatggtagtccaggaggggagttttatcccttgaaccaaaaattctcctgcgggaacatttactttgacccggccgttcccgatcgctctccgaaaggcttccgtattgtcccggccgtcagggaccgctccgtaatcctccacattcacttcccgggtgattttattcataagcatttcgtattctgtatcaagccgttcttttaaaagtgaggtgaccattccttccgccgtcacccgggcatctgcgatctcaagattatcatccgttgcggaatgcttaataaaattctgcatccttgctttgagatgctccaattcagagggatgtgcagggcgagactgcaatggggcgtttaaagacggatcaggaaagtttttaaattgaaccattctaaagacacctctttcttttgatataagcgcctgaggcaggggacagaaaaatcgcgcgccctttaagcgcttattcttcaaattctttattcagaacgaaattccttttgaaaccaaggtgaaatttaaaaaaagctctgttgaaagaacggatataaagctttacattattgtaattgaaactgtcatgtgaaaatggaggaaaaaactgataggaggggtcctcattttaggtttattctcattgtcttcgccgtgcttcctcttcggctgcatatacaccaaaatcaacattcttatcagttaaatggtataatggggcacggattggtcatcaatacgactgaaatagggaagcaaaaggagcagcgaacatgactttacaaatcaaaattaaatattcagatgatacgcaaacgagaatcagtaaaattgaacagggcgattggattgacctgcgggcagctgaagatataacaatcaaaaaaggcgaattcaaacttattccgcttggagttgcgatggaactgccggaaggatacgaggcccatgtcgttccgcgttcaagtacatataagcatttcggtatcattcagacaaattcaatgggagtcattgatgaatcatataaaggcgacaatgacttctggttttttcctgcattcgctcttcgggataccgacatttccaagggggagcggatctgccaattcagaatcatgaagaaaatgcctgaagtggagctgatcgaagtagacaagctcggaaacaatgaccggggcggactgggatcaacaggcacgaaataaaacgaaaaaaagactgcttaacagcagtctttttttatggaaacaacagttacattcaatttgtttcgaggattcttaaattgggaaatcaaacaaaactaaggagaagggtttcatttttatcatttaagctttccgtctctttgaacagaaagactttcttaggttaaaggatagaggttgttttgatgtttttattcttcaagatgaacggaggttttgtccaacgtatataatattgtgacaaaagtgcaaacaaaagaaaggatgatgttatggaaaaaagggttagaagagtagaccgtaaagcagctggcaaagaggcagagcagaagaaaccgtccaaagtcaccctgttctgccgttcgcttcaaaggctgaagcatttgtattgtaacataaacatacaaatgccatcaataaccaaaaaaggaatttcagttttaattttaccgtttttgcttctgccgttctttcgggctgatgccgcttcagatatttacggcagtttcgaggaattaaagctgaatgaagatccttccgatttttccatttcaacgcgggagcatgacccttctgtcctcatattagctatacacggcggaggcatagagccggggaccagtgagttagccagagaaattgccgaaaaccggagtttatatttatttgaagggttaaaatcagccggtaatgcggctctgcatttgacaagttcgcatttcgatgaacctaaggccgtgcaaatggtgaaagagcactctaatgtcatttcattgcacggttacggcagtgatgataaaaagataaaaatcggcggtacagacagagaacgggccgaacttttgaccgatgtgctgaaacggcacgggtatccagccgttcttcttggcacaaatgataaatatgcaggcgtcagtccgaacaaccttgccaatcaatcttcatccggattgagtatccaaatcgaaatgagcaccggcttcagaacatcactatttgacacttttacgctgaaaagcagagcatccacacaaaataagaccttttatcaattcacaaaaacgatttctgattttatcagtgacaattattaataagcacgcctattttgtcggcggggctttttcttttgaaatttatgaaactttaagttcttaagatcgtatacataattgacaggatgaaagaaaagaggtgggcaaatgaaagtgatgatcgggtctatcattcttcttgtcatcatcggattcggtttatggctgatgcttagtccaatctttaaacaagtgggaagcggagccaaaaaattaaaaaagtcatgggaggaagaagatcagcatgagcgaaaataagcgcggaaacacaaaaaaaattctcggcggtgtgattataggtgcagcccttttaattgcgggcgtcacagcgtcactattcattgaaaaaataccgaacggttatgtcggggttgtatactcaccgaatggcggggtaaaatccgacacattggaccaaggctggcacttagtcggattatttaataaagtaacggaatacccggtgcgtatgcagacagtgaataatgaaaatataaaagtggcaacctctgacggtaaaaatattgaaatggatatcgcttataactatgtcgtgcagcctgataaagtagtcgatctgtttaacaaattcggggcggtagatgtggaaacgatcgaaaatacatatttaaaaacaaggctgtgggatgcggcgcgaaaatcaatcagcaaatactcggttattgacacatacgggcaaaaatctgcagaagccgctgccgatgttcaaaagagatttgctgatgatatgaagagtcttggatttttaattgatgatctgacgcttggcgtaccaaagccggataaagccacacaggaagccatcgatgcaagggtgaagtcttcacaggaacttgaacggacacaaactgaaattaaaatagccgaagccgaagcgaaaaagaaaaaaattgaagcggaagggatcgctgactataacgaaatcattaagaaatcaatgtccgatgaaatgatcaaatataaatggattgaaaaatgggacggaaaaacgccgaaagcgacaggcacagactcactgctgcagctgccgctggacgatcagaagcaaaagtaaaaagagaaggaggcgattgcctcctttttatgttttttcctgagggtctttttccggcactaattcttcagacgcctcggtttgatagctccatagcgtgctatccgtctctgttgtgtcctgataatcttcgggaagtacatattgctgcaaataccggtgaaaaaatgcctcaaaaacagaaatgcaaagtgcagagataaccgatgccgcggcaggagagacattaaacccgccaatgttcatcaggaatatccataatataatgaatgaaattccgaaatcagctgcaacggctgtgaaattgcttgttctcggcagaatcatgcaatcacccgcaaaataagtgattaaacttaagatcactgtaataaacagaacgtttaaaaaggttacttggtacataagatccagaacaatgtacagtaaagcaagtgtgagcgccgttttagaagcgaaagcaattacgtgtttcatttgaaccaccttcgttatttcgtttattcttcattataagcaatccgcaaatttttaaactggtatatagtggttataaagtaaaatgtgaatagacatcacaggattcacaagttaaaatatgtaaaaagggggatgaaaatgaaaaaatattggatatgtattgctgtttttttattatgttttagcggaatacactcagctaaagcggctaccattgaattcggatcaaaaacaagcttcactttggagggaaacgcaaaagagtttcatattgaaaatccgggggctgtagctgccgacgattattttttaggctataagttcaccataatgaacgactcttcgtgcggtttaagcatgaaactccagcggatggcgctgaacggaaatttttatacattaagttctaaaaactacagcggcagctggctaaacctcagtgcccaggataaaaaatcaattgatccgtatcacaaatacaggattctggttgaaagttcttcaaacgtctgtggtcccgtctatattaaagggttttacggtgtagaatattatcattttgattgaaaatagatactcgctaaaggcagcgggtttttttatatttaaatataacttattgtactatgtactaaatattcatatataaattttgatgcacccgcccaaagaaaagataaacaaaagcaaattcatcacgcacaaatatacaaagttgaaaaatggatgaaaagtttcttgagggaaacattattagttgacttcaaaagtgtgatgtcggataataagaatgtaagtttttcctccttagcagattcgtttcttaagccagggcgaatctgctttttttatgcaaaaaaacccctctgtaaggggttttttacgataaatgaagtttaatagaattaatggacggctctgaatacgccgatcacttttcccaaaatgcttacgttttgcaggataatcggctccatcgtcggattttccggctgcagccgaacataattgtcttctttatagaagcgcttaaccgtcgcttcatcatcttcggtcatagctacgacgatttctccgttattggccgtgttctgctgtttgacaatgacgtaatctttgtcaaaaatgccggcgtcaatcatactttctcccatgatttctaacataaagacatgttcgcccggaggaaccatccggtcaggaagcggaaaatactcgtcgatattttcaacagccgtaatcggaatacccgccgtcactttcccgatgaccggaacgtttacgacctggcttttcggaatatggacttcttcttcatccaatacctcaatcgccctcggtttagtagggtcccgtctgatcaggccctttgtctccagccgcgccaaatggccgtgcacggttgaactggaagccagtcctactgcttctcctatctctcttacagaaggcggatatcctttcgtttttacctcttctttaataaaacgcaggatatcaagctgcctttttgatagcttcgtcatatttcgcacctcaaaacgtcgattttaagtagattatagcatgattttcctgacagtacaaacataggttcgaaaaaaacgattgacagaaacatttgttcgtatatactgaaagatataaaaagcgaacaaacattcttatcggaggttgtttacatggcgaaagaatctatcatatttgtcgggctgtttactgcgattttaagtgccgctattttacttgtctcatgtgcgggaaatgatcagtccctcagccaatatgttaaaataaaggttcaggacggcgatacactctggtcacttgcggatcatgtagcagaaaagaaacacattaataaagaagatttcattgagtgggtgacggagaataatcatctccaaactgctgatataaagcccggagacgaacttattcttccgattaagaagaagcatccggccgtatatcagctggccattgtcaattagagaggaaagagagaaatgaaggcgctcatttatgcccgcgtaagcacaaacaaagaacagcagcaaacgtcattaaaaagacaggaagaagagctcagtgagatcgctgctgcaaacggcatggaagtcgtgaaagtcatttctgagaaagccagcggttatgaaatggaccgcgacggagtatttgaaatgcttgatgaaattaaaaaatcacatattgacgcgatattggtgcaggacgaaacgagattgggaagaggaaacgccaagattgcgcttttgcattgtatttacagggagaacgtaaagatatatacgacggctcataaaggtgaactggagctttccgaagctgattcgatggtacttgaaatcgtcagtattgttgaggaatatcaaaggaaaattcacaatatgaaaatccggcggggaatgaaaagagccgtgaaaaacggctacaaacctgaacggaacctgaaaaacagacatgaaaacagcggaaaagaaaaaaaagaggttccggtttcggaaattatcaggctgagagccaacaagcttacctttgcagaaatcgcagcgaccctaagaggattcggctatgacgtgtccaaagccacggttcaccggcggtttcaggaatataccgcagacacagaaggcagctgacgcgcatcagttgtaaaaaagactgcgttttagtagtatataatcaacacgcaccaaaggagcttattatgatttctaaagaaaaaatcgcaagaattaacgaattggctcaaaaagctaaatcaaacacgataacggatgaggaaaaagctgaacagcaaaagcttcgccaggagtatttgaaaggattccgctcctcaatgaaaaatacgttaaagagcgtaaaagtgattgatccggaaggcaacgatgtcacccctgaaaaattaaaaagagaacaacagaaaaataatcttcattaaacagaaagaatacggcaatacgtattcttttttcgtatatactaatatcaggatgtgctttacgacaattttcaacaagtttatctcaaatttaagctgaaagagttgagaaaaagtcagcatcgctttatgatgaaaaggtacaacaataaggaaggggattataatggatacaattgaaaagaaatcagttgccaccattcgtacactatctatagacgcaattgaaaaagcgaattccggacatccgggcatgccgatgggagccgctccgatggcatacacgctgtggacgaaatttatgaatgtaaatccgcagaatccgggctggtttaaccgcgaccgctttgttttatcagcaggccacggttcaatgcttttatacagcatgctgcatttaagcggatatgacctcagcattgaagacttgaaacagttccgtcaatggggaagcaaaacaccgggacatccggagttcgggcatacagccggagtagacgcaacgaccgggccgcttggacaggggattgcgatggcagtgggaatggcaattgcagaacgccatctggctgagacatataaccgtgattcattcaacgtagttgatcattatacatacagtatttgcggagacggcgatttaatggaaggcatttcttccgaagccgcttctcttgcaggccatcttgaattaggccgcctgatcgtattatacgattctaatgacatttccttagacggcgatttagaccgctctttctctgaaaatgtaaagcagcgttttgaagcaataaactgggaagttctttatgttgaggacggaaacaacatcgctgaattgacggctgccattgaaaaagcgcgccagaatgataaaaaaccgactttgattgaagtgaaaaccacgatcggtttcggttctccaaaccgcgcgggcacatccggcgtccacggcgctccgttaggactagaagagagcaagctgacaaaagaagcgtatgcttggacgtttgaagaagatttttatgttccggaagaagtatacgggcatttcaatcaagctgtaaaagaagccggctcgaaaaaagaacaggaatggaatgaactgttcgcggcttataaagaaaaatatcctgagcttgctgaacagctgtcactcggcatgaaaggcgagcttcctaaagactgggatcaggaagttcccgtttatgaaaaaggcagcagccttgcttcccgcgcatcttcaggtgaggtgctgaacgggatcgccaagaaaattcctttctttgtcgggggatctgctgaccttgcgggttcaaataaaacgacaatcaaaaatggaggagacttcacggccaaagactacgccgggaaaaacttctggttcggtgtccgtgaatttgcgatgggcgctgcattaaacggaatggcgcttcacggcggcctccgcgtattcggcggcacattctttgtattctctgattatttaagacctgccattcgtctggcatcattgatgggactccctgtcacttatgtattcacgcatgacagtattgccgtaggagaagacgggccgactcacgaaccgattgagcagcttgcttctttacgcgcacttcctaacctttctgtgatcagacctgctgacggaaatgaaaccgcagctgcatggaaggttgccgttcaaagccaagatcatccgacagctcttgtattgacacgccaaaacctgccgacgattgatcagcaggctgaagaagcgtatgcgggcgtggaaaaaggggcttatatcgtttccaaagcccaaacggaatcaccggccgctcttcttttagcgacaggttctgaagtcggacttgcgatcgaagctcaagcgaaactggctgaagaaaacattcacgtatctgtagtcagcatgccgagctgggaccgctttgaaaaacaatcggccgagtacaaaaacagcgtgcttcctccgaatgtgacgaaacgtcttgcgatcgaaatgggttcaagcttcggatggggcaaatttaccggtcttgaaggagacgttctcgcaattgaccgtttcggtgcttcagctccgggagaaacaattatgaaagaatacgggtttactgcagaaaacgtggttgaccgcgtgaaaaaacttctaaacaaataacgagacaaaagaggatgagtcaaatcatcctctttttcctgtttatgcgacaaaaatagaaggggcggcgtaacagtaatagacaattctttcttttctccttttgtataatagaaagcaataacgaagcgctgtaaaaggggatgaggaaatggaacgtcattactatacgcacctgataaaggatgagtttgcgaaccactacttcgggcgggaaacggctatgtttgagttgtttcgagactatcattggacagatctgacaccccaggaatatcaaatgacagaaaagcaagttcaatatataacggaaccgattccggtgatacatatgcatcagcatctccagctgcatttaaaccgaatgagttacagccgtttggattccatttaccggcttacactgcccggagaaaagggccgcgccaccttcatgatgaaagacagtttaattgagattgcggcttcgggagattatgaggcggaaacgattttctttgagattctgcgtaaaatcagcccctgttttcttgcaatggatttcaagacacggcgctacgggtggttaaatccggtcagagaaagaaattttgtctaaaaacgaggaaaaagagatgtaaatgttgtataatagcctttggtttagtacactttaaactagacaacatgaaggaggaaataaaatgactttatgggttggcatcctagtgggcgttgtcgcattgctcataggtgttgcactcgggttttttattgctcgtaaatatatgatgagctatttgaaaaagaatccgcctattaatgaacaaatgttacgcatgatgatgatgcaaatgggaatgaaaccttctcaaaagaaaattaatcaaatgatgaaagccatgaataatcaagcgaaataatacgtacagattatgatatagagatacatggttataaaaataaaaaacccggagagggttttttattttggcgtcatgtttcaccccaactgccggtgtgcagttctttttggtattgtatgagaaggtggtcaagctcctggctgagttctatcgtaatgtttgatgtcattccgtttgtcatgacgattttaagcagctctgcccgttttttttcaatttcatttaatagatgctctctaatcacagggatatatcctttcatacataaatctttcacctgagtcgctattattatatccacatttatactgtttttcaaataagaaggagtataatatctcgatgtcaaattaaattatataagctttttctataaaaagtaatccttctcgggaaagtgttaaaaaaatgaaatgattttgtcataactcgaagggagtgtgtcatcgtgagttttaattactttctgacgtttggggccggatttctgtctttcatttctccatgctgtctgccgctgtaccccgcctttttatcttacataactggtgtcagtatggacgaggtgaaaacagaaaaggtgatgctgcaaaagcgtggcctcgtgcatacactttgttttttgcttggtttctccgtgatttttatcgcattgggatatggaacttcgtttatcggcagtttttttacccaatatcatgaagcgatccgccagttcggcgctatcatgctgatccttttcgggctgattactgctggcgtgtttcagccgaaattcatgatgaaagagcggcgcattcactttaagcgccgtccggaggggtttatcggttcggttctgatcggtcttgcgtttgcagccggatggtcgccgtgcagcgggcctattttaggagccgtgttttcgctggcaaatacaaatccttcttcagcagtgccgtatatgtttttatatgttctcggttttgcgattccttttcttgttctttcattttttattaccagaatgaattggattcgcaagcatcagctgcttatcatgaaaatcggcggcattcttatgattctgatcggagttatgctgttttttaactggatgagctacattctgatcgttctgtcaaatcttttcggaggatttacgggtctgtaacggattaataacttttgaactattatataccctttcgtttttggtacaataagactagttaatgttaaatatgtggaggggaatatgacacgagttttagttgtagatgacgccaagttcatgagggtgaaaatcagagagattctggaatcggcaaattacacagtggccgggaagcggctgacggcgaggaagctctggcagtatatcaaaaaatccgtcccgacctggtgacaatggatattaccatgccggtcaaaaacggtatacaggcgctgcaggatattttagcttttgacccgaaagcccggatcatcatgtgcaccgccatgcggcagcagcggatcgttctggaagcgattgaattaggcgctaaagactttatcgttaaaccgtttgaagcatctaaagtgctggaggccgtaggccgggtagcgggaacgtaaacgtgttctcttttcaaattggttttttttatgtttttggagtatagtatatagtatcaaactccgtgcaagcaaaggaatgataaagatgatgattataatttcatccgttattgcagcggccatggcaatttccgtgatgatcgtcaggattaaagcctccgacaagcccgcttcacctaaaaaaataattctcccgccgattttcatgagtacgggagcgcttatgttcctttttccgattttcagagtgacgggcgaagaatttttggaggccattacgctgggcgtgatcttctctatttttctgattaaaacatctaaatttgagattaaaaataatgaaatctatttaaaacggtcaaaagcgtttgtgtttatcctgattggtttgctggttatcagaatcgctatgaaatctattttgagcacgacgattgattacggagctttaagcggaatgttttggattctggctttcggaatgattgtcccgtggcgcatcgcgatgtttatgtcttaccgcaaactttctaatgaactgaagaccgctgatattcagatgaattaaaacctttccgtccgccggaaaggttttttatttgagcagggcctgataaggagtaagatcaatctgtttttcgcgaagatgcttttttaaaaattgatgatcacgcttaggagtggcgagtatgtaacccctgatgattaaatcacggtttatttgttcagcttcctccgctaaggaaagttcaccgatttttccggcgattttcgctttggctacatcccgaaagagctccggcacgggagcgaccaattcatccaaaaacgccttgtcacccgcattccataagtgcctgcttttttcaatataatagtcctgccaatccagttctgaccggccgtcttctttcggtaagcgttttaaaaattttcgaaacataaaaaacccgccgatagacagcaatccgatcatcacgatgacccaaaataaaataaaccacataaaccagccttctagcattgttctatctcctccttactttaaccatattgtaaacgaagacagaatagaagaacacatgaaaaaaagaatagaaaaaatgatagatgtccagtcattccggttgctagaacatattctatcgtatagtgattctgctatttggccatgggagattcactttgagggtatatgactgatatgaccggacaaaaaagccgcttccattgagggatgaaagcggcttttttatgttatagaggaaattgaaaggaaaatgaggcaggagtctcattaggctccttgttcatggagacggtcagaatatggttggtgaaatcagtgaaaatatgtttgtcattcagataaaaaggaagcaccatttgtttgtttaacgtccgttcaagcgttttaacagagagcataaactcatttcccgaaagagtgacggtgatcgcctgcacctgcttcagcgccgtcaggtcggcttcaatgatatattgacggcttgtttcatatagatcgatcggcagcgtctcgtcataccaagcatacgggtcctcgtaaaactgccgcagccattcttccgtatcatcaaattcttcagcgttttttgagtgattcatggaagcattcctccatattaaaaagccttgctataacgtatgcagaagctttaaatgggtgaatggcacaaaaaaacagacaccggggtctgttttacatatcgtggcttgtattatgtttttgtcttgtatggttgcggttttttacttttttgcttccgctcagcggttcaggctggccggggttatggcccttcggagcatttttatgcatatctttacttgtatttttatttgtcatgttaaagcctcctttttaaggtgttccggctattggtttgtttttctttttttattgttctgccgttcttcttccgtcaggacgagctggtcattttctatataacccgcgcctttgccttggcttttcgcatcattcatgccgttaattacatgattggctttccgttttaccatgatcatcacctcaacattaatatggctctttacagcccgttgtatgaggcggaaaatcggacaaaatttaccgaaaatcatgctgataagacgatcttattgtatttaataaaaacattgatatttacttatgtatgattttatactaagatgaaattgtgagaaaattgtgatggaatgtgaacattcatctaaagaacgatcttgatcattgaagggggattttggagaatgacaaatcagcaaaaagtcgcaacacaagacgttttccaagcaagaaaaacattttcttcaaatgggaaaacatacaactactattcattaaaagcattggaagacgcaggggtcggcaatgtttcaaaacttccttattctattaaggttcttttggaatccgttttgcgtcaggtagacggacgcgtcattacaaaagaacatgttgaaaatttagcaagatggggtactgctgaattaaaagatatcgatgtgccgtttaaaccgtcacgggttattctgcaggactttaccggcgttccggccgtagttgacctggcatctttaagaaaagccatggcctctgtcggcggagaccctgataaaatcaatcctgaaattccggttgacctggtcattgaccactccgtacaagttgacaaagccggtacggaagatgcgttagccattaatatggacttagaattcgaaagaaatgcagaacgttataaatttttaagctgggcaaagaaagcgtttaacaattatcaggccgttccgcctgcaacaggtatcgttcaccaggtaaaccttgagtttttggcaagtgttgttcatacgaaagaggaagacggagaacttgtgacctatcccgatactttggtgggaacagattcccatacaacaatgattaacggaatcggcgtcctcggctggggtgtcggcggtattgaggcggaagcgggaatgctcggccagccttcatatttccctgttcctgaggtcatcggcgcgaaacttgtcggaaaattgcctaatggaacgacggcgactgacttggcgctgaaagtcactcaagtgctgcgtgaaaaaggcgtagtcaataaatttgttgaattcttcggtcctggtgttgctgagcttccgcttgcggatcgggcgactattgccaatatggcgccggaatacggagcgacttgcggattcttcccggttgacgaggaagcactttcttacctgcgtctgaccggccgtgaagaagagcagatcgatattgtggaagcatactgccgcagcaacggtttattctatacgcctgacgcggaagagccgatttttacagacgttgtggaaattgatctgtcaaaaatcgaagcgaacctttcaggcccgaaacgtcctcaggatttaatcccgctttccgttatgcaggaaacgtttaaaaaacatcttgtcagcccggccggcaaccaaggattcggagcggatgctgctgaagagaacaaagaaatttcatttaaacttaacagcggtgaagatgcggttatgaaaacaggggcgattgcaatcgccgctattacaagctgtacgaatacatcaaacccttatgtattaatcggtgccggattggtagccaaaaaagcggtagaattaggcttgaaagtgccgaattatgtgaagacttcacttgcaccggggtctaaggttgttactggatacttagtcaactcaggtctgcttccttacatgaaggagctcggctttaaccttgtagggtatggctgtacgacatgtatcgggaactccggcccgctttctccagagattgaagaagcagttgctaaaaatgatctcttgatcacttctgtcctgtcgggtaacagaaactttgaaggccggatccatccgcttgtcaaaggaaactaccttgcgtcaccgccgcttgttgtcgcatacgcattggcgggcactgtaaacatcaacctgaaaacggacccgatcggtgtcggaaatgacggacaaaatgtttatttcgatgacatctggccgtccatggatgaaatcaattctctcgtcaaacagactgttacgccggaattattccgcaaagagtatgaaacggtatttgacgacaaccagcgctggaacgaaatcgaaacgacggatgaagcgctgtataagtgggaccaggattccacttacattcaaaacccgccgttctttgaggaaatgtctgtagagccgggaaaagttgagcctttaagaggacttcgcgttgtcggcaaattcggcgattccgtgacgactgaccacatttctccggccggagcgatcggaaaagacacaccggcgggcaaatacctgcaggaaaaaggcgtttctcctcgtgactttaactcttacggctcacgccgcggaaaccatgaagtcatgatgagaggaacattcgccaatatccgcattaaaaaccaaatcgcaccgggtacagaaggcggatacacaacacattggcctaccggggaagtgacatctatttatgatgcctgcatgcggtataaagaagataaaacgggtcttgtcgtcctggccggaaaagattacggaatgggctcttcacgtgactgggctgcaaaaggaacaaacctgctcggcatcagaacagtcattgccgaaagctttgaaagaattcacagaagcaacctcgtcttcatgggtgtgctgccgctccagttcaaacagggtgaaaacgcggatacactcggcttaacaggtaaggaagtcattgaggtggatgttgatgaatctgtacgtccgcgcgacttgctgactgtcagagcaatcagtgaagacggtacggtaaaaacgtttgaagtcgttgtccgtttcgacagtgaagtggaaattgattactatcgccacggcggcattttacaaatggtgcttcgcgataaaatgaaacagtagcagaatgaacaaaggagagaaagcagtctgctttctctctttttatgcgggaggccttaagatgcttgcgaaatggctgggcggaatgttacttatcgggttgttagtgtatgcgggctggaacatttattctgtgcaaaaaagtccgaaagaagggacagaagaagggatgaaagcccctgactttacacttgatacattgtcaggaaaaagtatctccctttctgattataaaggaaaaaaagtgctcctcaatttctgggcgacgtggtgcaagccgtgcagaatggaaatgcccgatatgcaggagctgcagaaagaatatcctgatattgcggtagcagccgttaattttacatcctctgaaaaaaatatacaggctgtgaaatcatttgctgatcattatcagctgacctttcctattctgattgacaaaagcggaattaacggggatttcaacgtgctttcttatccgacaacatacatattagacgaaaaaggaaccattcagcacattcgcgtaggcacgatgacaaaaaaagaaatgaaagaaaaactggatctcaaatagaggttcagtttttttattgtaaagggcttaggttttgaaaaattggaaaaaatgaatgaaaacacggaggtgagaagattgaaaaaaatgcgaaaacgttcttttcatgaattggttatggaaaataaacgtgagctgatgaccaatacggaatatttgaatcagcttgaagaaaagctggagcagcggttcaaacaaaaataacctttaatttgcagtcatgtttacacctccttttgcaaaatatactcttaaggagggatgaacatgggcataaacaagaaagacggccagccgcaatacgctccgagccacttagggacaaaacccgttaaatataaacgcaataaaggggaaaagtttcatgacaagtcaaacggacatccgattgtcatgcagacgaaaggcgaataacatcatcaaaggagagcagacattatgacaaacaatgatcaaaaaccgaatccggatgaccgttccgataacgttgaaaagctgcaggatatggtgcagaatacaattgaaaatatagaagaagcgaaagaatcaatggaatttgcgacagatgaggaaaaacagcgcattcaagagaagaatgccagacgcaatgaaagcattgaatcgttccgcagtgaaattcaggatgaatcggctgcaagagaaaacggctatcaatcataataaaaaccagggaaacctggtttttttctctttccggctcgttgtgataaaatggggctaatctgataaaaagggagcagagaacgttgcgtgtgtcaaaaaaagaaatagaagtgcgttatgcggaaacagatcaaatgggcatcgtctatcatgccaattacttagtctggatggaggtcggcagaacggcgctgattaaggaactcggattcctttacaaagatatggaagatagaggagtgctgtcccctgtattggatatcagcatttcttataaaaagccgctccgctacggagaaacggctgtcgtacatacttggattgaagaatataacggatttaaaaccgtttacggctaccacatctataatccggatcaagaacttgccatcaaagcgacatcctctcatatatgcgttgataaagagagcttcaaaccgattcagtttcgcaaggcttttcctgattggcatgccgcttacgaaaaggcaaaaaaataaggagcggctgcagttatggcatttggaattacgcgtaaggaactggaaagatggaagcgggatgtatcggaagggaaaatcgcttttttaacgcattactggctggacgaccgctttccggaggctaagaccgtgacgaaggccggttcaagcgatctcaataaactgatcagatggggagcggagtacgggctgaagccggagtggattcaccataaaaatgaatttccccactttgacctgctcggagaaacgcaaagaagcatattagaaaaagaacgtctgactgatcatctcaaaaggttcaggctgtaaaaaaagaacgcatccgctgcgttctttttttacacgtaatcaaataccggctcttctgcctgatctgaatatgtgactgacaaatcgtgattatcaaagtaccataagtcgctttcttcaataaaaaaggtaatgccttcaacttccgtgctggtgccgatgttcatcggccggtcttttaaaatgccgagagaaaagcctttctggacgttgctgcatcccccgtaacggacaaagaaacggacatggtcgcctgtttccagatcgagctcttctttgtaccaatccagcgcgcctttcgttactttcatgttcatccggaacactccctttttgtttctcatataaagaaattatctctattataaacgcatatggcattttgatgtcaaaattgaagtttcatcaaaaccatttgatcttaggttctgttttgtttataatccgtttgatgtttgccctgtgtctgtagataacaaacgcggtcaagagcgtcactacgattaataaataagggtcttttacaaacagacagtaaataatcgtataaatccctgttaacattgaagacagagaaacaaatttcgtaaggaataaaaatacgaaaaatactgcaaccatcgtaacgaataacagcggagcataaaacagcaggacgccccctgatgtggctacggctttgcctcctttaaactttgcgaacaccgggaatacatggccgatcactgctgccacccctgcgagaagaggatgaatggggacgtgcagtaaatatgggagcgctgcggccagggtgccttttaaaatatcggctgcgacgacgacagatcccgctttaacgccaagcgtgcgaaaagcatttgtagcgcccaaattgccgcttccgtgttctctaatatcgatccctttcgcaagtttgcctacgactaaacctgacgggatgctgcctattacataggccaaaataatcaataaaacaatcaacatctacatttctccttttcaatgtcccttcactctattttaacacgagttgttaccgtctgatgacaagttttttgagaattaagctgacaaagcgctttttttgattccggcgaagcggtcatgtacaatatatcaaaaggagatggtaaagatgcaaaatccttcaaaatcagagattaaagaaattctggaccggagcaaacggatcgcagtcgtcgggctgtcagaccgtcccgaccggacttcttacatggtttccaaagcgatgcaggatgaaggatatgaaattattcccgtcaacccaacgattgatgaggcgcttggcgttaaagccgttgcttcgttaaaagacgtggaggggccgattgatatcgtgaatgtgttcagacgctctgagcagcttcccggcgttgctgaagaatttttacagacggacgctcccgttttttgggcgcagcagggccttgcaaatgaagaagcgtatcgcatgattacagacaaaggacggacggctgttatggatttatgtataaaagtcgcccgcgctgttataaaataggaacaaaaaaggcaaaaatccttggcaaatcaggggtttttgcttttttattgaaagaatactctttgcgtatgatgatgaaacagatacaataaagcatgaacagcttttttagaaacccctttatacaggggtttgcagtctgtttgcgatggccggcataaagctatataatagaaagcgaactcatgttcttatctgccgaaaagggcaccaaaaagatgaaaagccgttcgaatgtatgtcttgcggcctaaaaaaacgagccattcgcttaaatatgttgcgaaatcaagcatattggttataattgtgagtccgaggagaattggaccgaagcttgcgcatactgaaaaacaaagacatgaaaacatttaaaaaagagaatgattaagagcaggttttttgaaaggggtttgtacgtttggctagaaaacagcaatttgattacaacgaagatgccatacaggtgcttgaaggcctggaagccgtcagaaaacgaccgggaatgtacatcggttcgacggacgcacgcggcctgcaccatctggtatatgagatcgtcgacaattccgtcgatgaagttcttgccggctacggagatcatattatcgtaacgatacataaggacaacagcatctctgtacaggacagaggacgcggaatgccgaccgggatgcataagctcggaaagccgacgccggaagttattttcaccgtgctgcatgccggggggaaattcggacagggcggctataaaacaagcggcggtctgcatggtgtcggcgcatctgtcgtaaacgcattatcggagtggctgacagttactattgagcgtgacggatatgtttataaacagcggtttgaaaacggcggcaagcccgtgacttcacttgaaaaaatcggaacgaccaaaaaaacgggaacgcttacccattttaaacctgatccgtcaatgttcagcgcaacggtttataattttgacacgctgtcagaacgtctgcgcgaatcggctttcttgttaaaaggtttgaaaatagaattaattgatgaacggaacggcgtaaaagaagtattttattatgagaacggaattgaagcatttgtcgcttatttaaacgaggaaaaagacgctttatgcgaagtggtgtcctttgaaggcgagcatcatgacattgaagtcgatttcgcgtttcagtttaatgacgggtattcagaaaatatgctgtcattcgttaataacgtcagaacaaaggacggcggcacccacgaatcaggagccaaaacggcaatgacaagagcgtttaacgagtatgcgcgaaaggtcgcccttttaaaagagaaagacaagaatcttgaaggcgccgatatcagggaaggtttgtccgcaatcatttccgtccgtatcccggaggaactgctgcaatttgaaggccagacgaaagggaagctcggcacaagtgaggcgagatccgccgcggatgccgtcatttccgagaatcttgcttatttcttggaagaaaaccgcgatacggcaaccctgcttgtcaaaaaagcgattaaagcaagccaggcccgtgaagcggcccgtaaagcgagagaagaagcgagaagcggcaaaaagcgcaaaaaatcagaagcgacgctgagcggaaaactcacaccggccggttccagaaatccggcgaagaatgaattgtatctggtggagggagactctgcgggaggttctgcaaaacagggaagagaccggaaattccaagccgtgctgccccttcgcggaaaggtcatcaatacagagaaagcaaagcttgcagacatcttcaaaaatgaagaaatcaatacgattattcatgcgatcggcggcggtgtcggcgcagattttgatatagacgacatcaactatgacaagatcatcatcatgacggacgcagataccgacggcgcgcacattcaagtcttgctgttaacgtttttctaccgctatatgaaacctttaatcgagcatggaaaagtcttcatcgcccttccgcctctttacaaagtgagcaaaggaagcggcaagaaagagattattgaatatgcttggtccgacgaagaaatggacggcgttttaaagaaagtcggcaaagggtataccatccagcgctataaaggtctgggagaaatgaacgcagaccagctctgggaaacgacgatgaatcccgaatcgcgaacgctcgtcagagtcaagatcgacgatgcggcacgggtagagcgccgtgtaacgacattaatgggagacaaagtagaaccgagaagaaaatggattgaaaagaatgttgccttcggattagatgaggaaagcaatattttagaaaatgaaaacttgtcggtcgctgaggaggtttaatagtggcacagccagaattatttcatgatttaccgttagaagaagtaatcggcgaccgtttcggacgctacagtaaatacattattcaagacagggcgctgcccgacgctcgtgacggtttaaagccggtgcagcggagaattttatacgccatgcacgcagacggaaatacattcgataaaaatttccgtaaagcggcgaaaacggtcggaaacgttatcggtaattatcatccgcacggtgacagctccgtttatgaagcgatggtgcggatgagccaggattggaaagtgcggaatgtgctgattgagatgcacggcaataacggaagcattgacggtgatccgccggctgccatgcgttatacggaagcgagattatcttctatcgcgtcagagcttttgcgtgatattgataaaaatacggttgaattcgttccgaactttgatgacaccagtaaagagccggttgttttgcccgccatgttccctaacttgcttgtcaacggatcaaccgggatttcagcgggctatgcgactgatattccccctcatcatctgggtgaggtcattgatgccgtcattaaacggattgaatctccggattgcaccgtcgatgacttgatgcaggtgattaaagggcctgactttccgacaggaggcattattcaaggagtcgacggcattcggaaggcttatgaaaccggtaaaggcaaaattattatccgcggcaaggctgaagtggaatccgtaagaggcggacgggagcaaatcgtcattacagaaattccgtttgaagtaaacaaagccaatctcgttaagaaaatggacgaataccgcatagacaaaaaagtcgaaggcatttctgaagtcagggatgaaactgaccgcacagggctccgggtggtcgttgagttaaagaaagaagccgatgcaaaaggcatcctgaatttcttatataaaaacactgatctgcagacaacatataactttaatatggtcgccatacataaccgccggccgatgctgatgagtcttacggccatcctggatgcgtatatttcccatcagaaggaagtggtgacaaaccgctccgtctttgaattgcaaaaagcaaaagagcggcatcacatcgttgaaggactgatgaaggcgctgtctgtgttagatgaggtcatagcggtcatccgggcaagcagcgacaagaaagatgcgaaacaaaacttaatttctaaattcgcatttacggagccgcaggccgaagcgatcgtatccttgcagctgtatcgtctgacaaacacggatattacggcgctaaaagaggaagcggaagagctcagcaagaaaattcaggagctcgaagccattttaagtcatgataaaaagctgttaaaagtcattacaagcagcctgaaaaaattgaaaaagacctatgctgacagcagacgatctgtcatcgaagaaaagattgaggaaattaaaatcaaccttgaagtcatggttgcctctgaggacgtatatgtgacagtcacaaaagacggctatgtaaaacgaacaagccagcggtcatttgctgcttctaacggccaggatttcggtatgaaggatactgacaggctgattcaccaattcgaaatgaatacaacggatgttcttctgctctttacgaataagggaagctatgtttattgtccggttcaccagcttcccgatatcaggtggaaagacatggggcagcacgtaacgaacatcatcacgattgaccgtgatgaaaccatcgtgaaagctataccggtaaaagaatttgatccatcttcatatttattgttcatgacgaaaaacggtatggtgaagagaactgaaatgacgcattacaaagcgcagcgttactcgaaagcgcttgttgcccttaacctcaaaggggatgatgagctgattgatgttcatgtcacagacggcgggagccagctgtttatcgccacccgtctcgggtacggtttatggttcggtgaagatgaagtaaatgtagtcggtgcccgtgcggccggcgtaaagggcataaatttaaaagacggtgataccgtcgtatcagggcaaatcctgcatgagacagattcgctcgtcctcgtcacacagcggggagcgatcaaacggatgaacctatctgaattcgaaaaaacatccagggcgaaacgcggtgtcatcatgctgcgagagcttaaaaagaacccgcatcgcacagtcggcgtattcgcgtgcgctttagccgacatgatcgctgcggaaacagaaaaaggcgagagaatcgaaatcgccgtgaagtccttgcggtcgaatgaccgatacagcaacggctccttctttaccgatgaagatgagacagggccggtaacagatgtatggcgtatccctgcatacgatgtttaagagtaaaaataaaaaacctccgctcattgagcggaggttttactatttagctttcatggctgccgaataagtcagtgatagcgtgaatgacttcgattccctgccatacaaataaattcaatgcagtgaatgaaaacaaccctaaaatcaccattcgtaagataaacaacatgtttaacaacctcctcattttatgttacatagataggcgatgttgaacatgaagctcatcgaaatacgaggactgataaaatttagcgattaaaaagcttttctttcgctgtcttctccgggaagcggggcgtctcctgtctgatatcacgatcagtgagacagaagcggcaaaaagcgccgtcaagatatatgagcccgtcagcgattttttctcatcatcagcattttggccggccttcatttcgtgcatttcctgctggtcggctaccgctttaaaatgatgagcggtatcaaacgcatggggaatggagagcaaatgaaagcttgcaatcgctaaaaataaaatagaagcttttaaaaacaagatttttttcaaatgttctccccccttcataagtctgaatatttttattataataccctaatttaaatgtaaagtaaacacatttattaaatttaaaaaattattatcctggttaagtatataccattccatccatcttttcatctcttttttcttaaagacctatttgttatgatatgcacgcattccttatgacgtgacaacatttttcgggctgtaagataaaaaacggggcatgacagcaaaagatgtgatgaagaaaccgaaacattttcttaaaaaaacttctcaaccactgttgttgtgatataataatacccgttgtgttaaaagatctaacatatgcagcaaaaatgacagtaaaagatatgtaaaagggaggttaaacatggaggctttcatcagtgaaatcataaatgttccaaatgattttatttggaagtatcttgtttatattttagtcgggatcggattgtactttacgttccgttttcgctttattcaattccagtacttttttgaaatgttcagaatcgtcggggagaagccgcaaggaaataaaggagtgtcttcaatgcaggcattctttatctcagccgcttctcgtgtcggaaccggaaacttgaccggcgtcgcgctggcgattgcaacaggcggtcccggcgcagtattttggatgtggatcgtagcgattgtcggtatggcttccagctttgtggaaagcaccttggcgcagctgtataaagtgcgttccggtgacgaattccgcggcggtccggcatattacatggcaaagggactgggcgcccgctggctcggtattttatttgccgtattgattaccgtttctttcggacttatctttaacgccgtgcagtcaaatacgatttctgtggcgtttgacgaagcattccatgtgaataaaacagttatcgcaatcattttagctgtactaacggctttcattatattcggcggtctgaagcgtgttgtttccgtctcgcaattaatcgttccggttatggcgggaatgtatatcctgatcgcgctgtatgtcgtgattgtaaatatctcggcggtacctgagctgcttgttacgattgtgaaaaatgcgttcggttttgagcagatcgtcggcggaagcttaggaagcatcattattatcggagcgcagcgcggcctgttttcaaacgaagcgggaatgggaagcgcgccgaatgcggcagcagctgcacatgtgtcgcatccggctaagcagggattaattcagaccctcggcgtgttctttgatacgtttatcgtttgtacatcgactgcttttatcattttattgtacagctttacgcctaaaggcgacggcatccaagtgacgcaagccgcactgcagcaccatctcggcggatgggcgccgacatttattgcgattgcgatgtttttattcgcattcagctcagtcgtcggcaactattactatggtgaaacgaatatcgaatttattaaaacaagcaaaacatggcttaatatttaccgcgtattcgtcgtagtgatggtggtatacggatgtttggctgacttccagatcgtctgggacatggcaaacttgtttatgggactcttggctctcattaacttagtggcaatcttactgctgagtaatgtagcctacaagatctataaggattatgccgctcagcgcaaaaaaggtcttgatcctgtattcaaagccgagaataccccggagctccagcatattgaaacatgggcggaagaagaaggtacaagccctgaacgtaagactgctaactgaggacacatgcatacaatattcaaaaaacccccttacattttgttgtgaggggttttttatgtgaaaaaacgggttatttttactgaaaacagatttttttgaatttattgtatttttctcttgtgtatgtaagggctttcatataaagtttaactaaaccggtttaccaaaccgatttagtcttaaaggaaaggagtattgatgtggcttctgattatggcatttttacgatcggtgatgcgatgatcaccttaaatcccgcaagcacaggacctttgcgttttgttacccattttgaacgaaaagcaggaggagctgaactgaattttgcgattgcatgcgccagattgaacctgcactcaaagtgggtcagcagactggggaaggatgagttcggcagagtgatttatcagtttgccaaaggagaaggaattgatgtgactgacgtctcctatgttgaaggctttcctacatctttaaatgtcaaagagatcagaaatgacggttcaggcaagacgttttactatcgtttcaattcaccaattctgactcttgcaccggaagatataacagagaatatgtttgccggcattcacatcgttcatcttaccggtgtgttcctcgcacttgataagaaaaatcttgaaattgctgaaagagtgctttccatcgccaaagcaagaaagattcccgtatcttttgatccgaatatcaggctgaagctgtggacgattgaggaggcgcgtgcggcatttcatcaaatctttccgcatactgatattcttctggcgggccgggacgaaatgaaacagctgacaggtataggagaaaatgaagcattagcccggtttgcagagagctattcaatcagtcagcttgttataaaagacggtgaagcaggttctgcgctgtatcatgatcataagtgggttcacaaagaggctttcccggttgcgcctgttgacacggtaggagcgggtgacggctttaatgccggctacctgtacagttatttgcatggttttgaaccggaaaaacgtctggagtttgcaaatgcagtcggtgcgctcgtcaccacagtttccggtgacaatgaagggcttccctgcctagaagaggttttgtcatttgtaaacaaagagactgtgattgaacggtagcaagcacaacttaaaaagcgggtgaaaaaatgaaagcggttcaagtacggaaagcatttgatctgagggtgacggaatgtgagaaaccgtctgttgtccacgcggatgatgttcttgtcaaggtgaagcgggtcggaatttgcggatcagatttgcatatttatcatgggacaaatccgttagcttccctgccgagagtaatcggacatgaagtcacaggggaagtcgcaaagaccggttctcatgtccggcgtttcaagccgggtgaccgggtagtgattgaaccgatatcttattgcggaacatgctatgcctgccggaaaggacgtccgaacgtctgcaaagcgctttcggtgttcggcgttcatgaagatggcgggatgcgggaatatatcgtgcttccggaaaagctgctgcatgctgtttcgcccgatctgccttgggaggaagcggtcatggcagaaccatatacgatcggcgcccaggccgtttggagaggccgtgtcgagaaggaagataccgttttgattcaaggagcgggaccaatcggaatctgcatattaaaaatggcaaagttcaaaggcgcttccgtcatgataaccgacttgaatgatgaacgcttagcattcgctgaaaaaaacggtgcggacgttactgtcaacgcgcaaaaagaagatcccgttttgcgggtgaacgaatggacaaaaaatgaaggcgccaatgtcgtcattgatgctgtctgtctcccctcaacgtttgaaacgtccattgacgcggtgtctccggccggtcatgtggttgtgctaggttttgatgagaggactgccggcatttctcagcttccgatcacaaaaaaggaagtcacgatcaccggttcaagattgcagacgaatcagtttccgtacattacagacttactgaataaaggcctgttaacgcacggcggtcttattacacatacattttcagcagatgacgtccatcaagcatttcagttgatcgaacagcacccgggcaaggtgggaaaagcaatcattacgtttgattaaaggaggagcgagaatgctgcctaagtacgccatttacgaaaaacttctgcatgcacaagtggtggctgtcataaggggacaaaacagccaagaggcgcttgaagtttcaaaagcggccatttcaggaggtatcagcgccattgagcttacatacacaactcctgaagtggaagatgtctttaaggaactccggcatcaagatattcttcttggagccggttctgtaatggataccgaaacagcgagacacgccattttatcaggcgcctcatttatcgtcagctctcattttgtaaaagagatagcatctctatgcaaccagtacagcgtaccgtatcttccgggatgcatgagcgtgtctgatatggctttggcgctcgaagccggatgtgatgtggtaaagctgttccccgctaattcgtttaatccctcatttatcaagtcggtcaacggccctctgccgaatgtccgcattatgccgaccggggtatctcattaaacagcatgaatgactggctttctgccggagcggtcgcggtcggagtgggaagtgacttgataaaagcatatcaaaagggcggctatgaagctgccgtatccctcagcaaagaatacgtctgccgaaaaaacgaatatacggggtgtaacatgaatatcacgtttcgctggtatggccaaggtaatgatacggtgactcttgaacatgtcagacaaattcccggggtcaaaggcatcgtctgggctcttcaccagaagcccgcgggcgaagtatgggaaaaggaggacattgaagcggaagtcagattcattcaatcctatgggtttcatgcagaggtcgtggaaagcgtgaatgttcatgaagccattaaactcggccatgaagaacgcggacaatatatcgaacactataaacagaccattcgcaatctgtccgaattcggcgtgaaagtcatctgttacaatttcatgccgatatttgactggacgcgtaccgatatgttccgcgcgctggaggatgggtcaaccgctttgttttttgaaaaagcgaaagtggaaagtctgcctccggaggaactgatccgcacggttgagaaatcttctgatttgacgcttcccgggtgggagccggagaaaatggcccggatcaaggaactgtttgaggcctatcaaacggtcggtgaaaaacagctttgggccaatctagaattctttttacatgaaatccttcctgtagcggaggaacaccggcattcaaatggccattcatccggatgatccgccctggtcaatttttggcctgccccgtattatcaccggtgagaatgttatgaaaagctgcgagagatttcagattcacccgccaactgtattacgttgtgcacgggttcgatgggagcggatcccgccaatgatatggtgaagatcgccaaacactatgcgggagctgcgccgtttgcccatatacgaaatgtgaaaatctgtgataacggtgattttacggaaacttcgcatcttaccagtgatgggtccattgatattaccggtgtggtaaaagaattgcacggccaaggctacaaaggatatgtacggcctgatcacggccgtcatatctggggcgaacaatgccggccgggctatggtttatatgatcgtgccttaggaattatgtacttgaacggactgtgggatgcgttctcgtctcatgagaaagaggtggaaggatgagaccgattcatgaacgtttatcaggaagaaccgctgtcataacaggcgggagcggtgttctctgttcagcaatggcaaaggagctttcacggcaggggatgaaaattgcgatcgtcagccggaatgctgataaagcagagcgtgcggcgggcgagattgctgacgctggaggaaccgcggtttctgtaccggctgatgtttcagcccgtgattctctcgaaaaggcaaaagacgagattatcagccggttcggttctgtcaatcttttaattaacggagccgggggaaaccacgctgatgcgatcactgccagtgagacgtatgaagaggatgagcagagcccatcattttttgatatggacgaaacgggattttccagcgtattttcaagcaactttaccggtgcatttctggcatcgcaagtgtttggaaaagaccttttgaaggcggaatatcccgcgattattaatgtttcttctatgagcgcgtatacaccgatgacaaaggtgcctgcctacagcgcggctaaggcggcggttcagaattttacgatgtggatggctgttcatttcgcaaaaaaagggctgcgggtgaatgccatcgctccgggtttctttttgactgcgcaaaaccgtgagttattattacaggaagatggaagtctgacagaccgatccaataagattatggcacatacaccgatgaaacgtttcgggaaaccggaagaccttctgggaacgctcctgtggctttcggatgattcatgctcaggctttatcaccggggtcaccgttcccgtcgacggaggttttatggcttattcgggagtgtgacagaatccagttccctgtcagattgtaaacgatttacttctgacttatactagtgaaaaatgaagacagacggggatgagtctatgaaaaccattacaatttctgatgtggcgaaatatgcaaacgtatctaaaagcaccgtatctcaatttttaaatcagcgctatgactatatgagcgagaaaacgaaacaaaaaatagaagcggccattcaagagctgaactatcagccgaatttcgtcgcccgcagcttaaaacagaaatcaacatttacggtaggtgtggtggtggctaatattcttcacaccttttccactcaggtcatcagggcggttgaagactattttcatgaacaaggatttcatattattgtctgcaatgcggatgatgaaccggaaaaagaaaagaaatatattgaaatgctcagggccaagcaggtggacggaattattatttttccgacgggcgaaaatctctccttatatgaaaagatgaaacgcgatacgtttccggtcgtgtttatggacagaaccattgaagaactcgggattccgacagtgatgcttgataaccatcatgcagccggtcttgccgttgaccggtttatcgagagcggcattaagagaatcgcgattattacgacgtccattattcgggaaatcagtccgagggtagagcggattgaagggtataaaaaggcgcttgaccgccacggaatgatggtgcggaacgaatatatcaaaacagccgatgcggctgatatttccaatgttttgtcagagctgttctcacttcaggagcctccgaaagcgatattggcggcaaacgatatcgttcttgttgaggtgctgaagtatatgaaggagcatgatatgacaattcctgataaggcagccgtcatcggaattgatgaagttccttttgcgggtttttttactcctccgattacgacgatcgtccagcctgcggcagaaatggcgcgaaaagcgggaagccttcttcttcgccagatacaagaaaaagatagcggtgaaaaacggatataccgctataaaccggcgcttctcgcaaggcaatccggataaccggtttcattgcataaaccggtttactccggcaatttaaattatgaaataagagggagggattttatgttctcaaaggatagattccctattattcttcttttattttcagccggggtgattaactatttagaccgctcagcgctgtctattgcagcgccgttcatacagcaggatctcacattgtctgcaacccaaatggggctgattttcagcagtttttctgtcggatacgctgtgtttaactttctcggcggtgttgcatctgaccggtacggggctaaattgacattgtgtacggcgatgatcgtttggtctcttttcagcggggcggttgcgcttgctttcggatttgtaagtcttttgattatccgtattttattcggtatgggcgaggggccgctgtcggctgccataagcaaaatggtcaacaattggtttcctccgtctcagcgcgccacggtcatcggcctgacaaacagcggcacgccgctcggcgcggagcgatttccggcccgattgtcgggatgattgctgtggcattcagctggaaggtttcctttgtcctgatcatgatcgtgggtttagtctgggcgtttatctggtttaaatttgtcaaagaacggccggcgccgacggaagacgccccggccatgaaagcggcgattcaatcgcatgagcagcatatcccgatgaccttttatttgaaacaaaaaacggttctcttcacggcttttgcctttttcgcctacaattacatcttatttttcttcttaacatggtttccgagctatctggtgaaagaacgcggtttaagtgttgaatttatgagtgtggtgactgttattccctggattcttggatttatcggtttggcggcaggcggaatgatttctgattatgtattcaaaaaaaccgccggaaaaggggttttattctcacggaaagtcattcttgtcacttgcctgttcgcttccgctgtactgatcggatttgccggacttgttaccactgccgtaagtgccgttattctcgttgctttatcagtcttctttttatatataacgggctctatctattgggcggtgattcacgatgtggttgatcaaaggaatgtcgggtcagtcggcggctttatgcattttcttgcaaacacggccggtattatcgggcctgctttaaccggctttatcgcggataaaagcggatcattctcgggggcgtttttgcttgcaggcggattagctgttttggcctcagctgcggtaatccgtttcgtgcgtccgattatcattcaaacagtttctgaagataaaaaagacaccataccttattcataagtcatcaaagtcattgaggctgtcctgccgataacgggatggccttttcgttctgccgtttgacctgttcctatgataatataggaattgtttacaaaagaagggaagagaagggagcatgaaacagaagccgatatatgtcgaaatcaatattgcatctgatatagaaacactttgggaatatacgcaaaacccgcatcttcataaggaatgggatctgcgtttttctgacattacatatcttcataggctgccagatgaaccgcagagatttctatatgaaacacgaatcggttttgggctgaaggtatccggcacaggcgaatcaataggtgacatgaggcctcgctcgtcagaaagagtgtcttcgctcgcttttgcctctgatcatccgctgtcacttataaaagaaggcaggggctactggaagtatatagagcgggataacggacaaacctcatttttgactcaatatcaatatgaaacggtccgcggtctgccgggaagttggatagaccggtttttatttcgtcctctgctaagctgggctaccgcatggagctttgatgcgttgcggctttggatagaacaaaacagacatccgaagatatcagtccgtttcggatttgtctatgtctgtatgtgtctcgtattcagtctgtattggttttttcaaggctttcatgatggctgtgccgatgcagagatcgtgaggggagcgctggagacagggttaggggtattatggctgcttcccatgcggagaaagtggctgattcacgccgggcagtcagtcttcttttgtgtaacggcactgctatattccggcggcggattcgtgatctctttaggagtgcttacgatagccggcatgattcttaagttcaagctgccgagcgcctggcatacaaaacgaaagagagaagtgaaatgacggattcaatgtatgaaaaagcgattactcattatcaatcactgcacccgatgctgcagaaacggtacagatttgacggatcacgcacgttttgcggagaaggcgttatgtcagaaataaagggaggttcttttcttgtcagaatgcttttaaagaccggtgtttttttcagatgttttttctcagagaggggaaacgatatccctttcactatcgaaaacaaaatcaggcaaaatggcgtggaatggaatcgtacctttttctttaaaagcaaaacgcgtttttttgatgcagtcatggaatatgatgagcgggaaaacagaattcttgattacttcggcaaacctcacatcctactgtctgaactgcatttagaagcgtcttcagacggagggcttgttattacatccggaaggcagtggctcctgataggcggaaagaaaatcccgcttccggcatggctgtgcggcagttcaaccgtttatgaggcttatgatgaggaaatgaattgcttcagcataaaggttcatgtgaaaaaccggatactcggcacgcttttctcttaccgggggactttccgggaaacagagggagaaacatgctgaagcgtcatctcatggtcagcgtgattagctttttgggatttgcggcggctgaagctccgtatatatcagctgctgagacgtttgttttattatccatactttttttcgttcccgctgtattctgctttgcttttcggccgtcaaagaccttagagaatgtgttgttacggagttatcctgttgccgctatatgtgcggcgcttgcgcttgtcacaggcttcagtttttttgcctttgtgtggctcatttatacgcttggactggcactgtatgctgtctggcggctgatgaaaacaaatattcacagaacagaagagatgtctgttatggcgggtttcatttatttggccgggggcggattctggttcttcgcatatgttcttgagattcccgtcatgaatttcggcccgcttatcgttctgctgacggcggtgcactttcactattccgcttttctcattccgatctttaacggattgctcggcaggatcatacgggagaaacgcgtactttaccggtggagcacggtcattattttgatttcgccggtccttattgccttggggattacattttcaaagacacttgatgtgattgctgtcgctctgtacctggcgggtctgtatgtaaatgcatatctcgtctttaaggcgccgtttgttacgaaaacaggcaggatcttgatcaggagttcttcggctgtgttaatgatcacaattgctttttctttgatatattcgtacggtgtctaccgcgaggaggcaacgctcacgatcagccagatgatttggattcacggggccgtcaatgcattcggcgttatcctgccggctttggcggggtggagaatagaaaatcctagaccgttcgatgagaacagtgaaagaacgttcagcagaatttacgggaaaggaacgataggcaaagattttttgactgacattcatgcagcaaatgacatccattataccggccttcaggatcagctgagagaactgcattctgaagacttttcaattgaaaagctggcgccggccgttatttccttttatgaagagacaattgattatgacatcatggcaaaagtgacatggagcggatggtttcgtccgttcgcgtgcgtgtacgagcggttcagcagaagagcggggcagattcatctgtccatgaatccggattggtatatcatgcacagtgatattataggaattgactctgacaaagacggcagaaaaaatgtccgtgcgtggatcagaacaaatgaaaagcaggaaaccgtttttactgcgctgtattcagcgtacagggcaaaaggggaaggatacatgaatatctctcttccgctgccgtacggccaaatgacgggcattttaaagccttatgcgcataagcagaatcttgttttgacaagcagacggcgaaaaagcggagcgggtgatgaagggatttatctccagacaaaatggggaacgtgtcatcttccgctggcagagacatttcttatttcagcccagagcgaaacaagcctgaaggccgttcatcatatgtggctgttcggactgaaatttttaactgtgcattatcggatcactcacgcttccgcaggtaaccgaagcaaataacaagctgcagagccgtctgttcatcaggcggctttttctcatgcaaagattcctacattgagcggcatgatgaaggcagccgggcagatggccctgctgaaaatcttgttctttttgtttatgattccgcacgcactggctctgttagtgatgagaacttttgttcgcaggtgcggaaactgggtcacattgccgtttttatttaaatcattccttttataataggtttttcactcggcattatctttcctttgctgcttggaatgtcgattgagtctgttccggcgggcatgagagcaacatcgatggggcataccaggcgctttatgcactcggtattttcggaggaccttggttgcgggattttttaatgattggctgggctcagagccggattttatttcgctgcagtgctttggctggcggctgtcatacttgctcggggagccgatgcgaaaaattcgtcggaaaaaagcagggaagatgcggcaaagtattatcagacctgattttttatatgcttgcctaaagaaatgatctcattgcgggtaatgaccaaacaagaaattcatttcaagcttgcttttgcgttaggttttatttcagctgaatcaaaactaacgctgtaaacatttttatacgtgtaacgctaactgcaataacacaatgtgcggttattgcagttataaatttctcttttttgtctcaataactaaagtatacttggtttatgagactggtaattcatttctctgtgtaacttcctagaatatatattatgtaaactagaaattatgaagagaatataaaagcgaatccatattctaacagcatccccttttttgtaaggtaatattaaaaaacctctacgtccttaataaattaaattggtcataaaggtttttcagtttgagtattttcatcggttatgtcacttgttgctggtcttcttgatcaagtccacgccatcgtatgccagactttccacacttgcagctttctgcaggatgtaatgatcaaaaaagttcttcgtatagtctgtaacaagatttcgcatctccgtggcatcccgttcgcctctaagttcctcattcacactggtaaacacgatgtcgcagtaatctaaatgcgcagcacgatcaacagagaaataataggtatccatgctattgttagccccaatgatcgcattcatgttatagttcggttcagaaaacagcagcaaaaagggtttcttaaggtcgctgccctgaaggccgaacgctccgctgtccaatccaatcccgcaggcaaaccggtcgtcgtcccggcaaacaatcgccgtcgtagccccgccataagaatgtccgactatgcccatgccgatgtcaagcaacaatctgtccttaaagatggaattcagctctccagagtccagtttgacaagataatcggctgcataccttacatcttccgcctgtaattcacaatactttgttaacttgccaagaatcggcagtgtaaacacgttatggcacatcttaatggcagtttcatcgtcaggacgcatctccatcttaccagacaacgccagcatctccggatcttcagaaaacgccaaaatggcatcagaaaaatcctttgatacattaaacaggcgcccatctttacgcttatacatcgtgctattctgatggccgatgcttaccgccacatatcccatgcttgccaagtctgtacagatcactgtgccccattctggagaaccgcctccgccgcaaacatagaataacaccggataacgcttttctttcccggagagagcaaggtcgtcgtaacattgggtcttgatatctatagagtaagcatccttcaacgcagtgagaagcggctgctcatcaagcatttcgcagacttcaggaaacatgtacgttgatgtagtcttcccttcgctgctgtcggacggatagtacacaaacgccgtcagttctctttttgtatgatctgatgccgtgtactcaaaatccatttgggtgcggccgacagtatagccgccaattggctctggaaatgcgtcataccttttcattctcttgttcccccttaagtaataaaagtggcggatgtgaaatacatacattgcgcgataaacgcttttcaaaactgtgaaacgattacattatatgttcagtgaatcattatctactccttcacgtaaacctccatgtattgctgtttaagatgataaaagcggacatcgttgctgatgtccgcctaaagcttaactaatggggttctgttccccaaatcagttttccttgatgatataatgtaatttttttcgttgttttaaacgtatttgattgaaaaaaggaatgatcgccgctttgtgcataattactccagtcatcattgtgaagacgaagctgaatattccctgtgcttgctcccggtgacagcgttcctgttttaaaacccagttccagataggtatctgcaccttgcttaggtttatgcagcgccgcaaatttgtgggtcagattgccgcatccaatctgcgcgtagtcacagtcaaagttttggcccttgtttttcgcgttataccagtaacgggcagtgacatcttttaaatcaaccgtcgcattgccgttattttttatgtgaagctgcgggcggatttggttgctgttcacacccccatcccctgctttgtattgtacagaaatgccgttttcctgtgcggggttatcttgtgctggcgtttcagggcgttctttcgttgaatctttgttgccgagaatgttttctcttacgaatgttcctgaagcagttaaatctgtaagcggccagccgcctgttttagatgctcccggctttaaagccgaagatgattcctgcttatcagaaagattccagttcacccagctgatgtttttgctgtcgagataattcagccattcccgcgactggtcaaggaatacaccgccatttccagacgcgtcgcttgttccccattccgtcacgaaaataggcgctcctttcctgagtgcatagtttgctttatcccgtaaagattggccgtgtgtgccggcataaaaatgaagcgcgtacatgacgtttgcatcttttagctggtcatcggctgcatcattcacatcttggctccatgtaccggttccgacaatgatgatgttgtctggatcatttttgcggataacggaaatcacttcttccgcatacggtttaatatcacgcttccagttcacatcaccgtttggttcgtttgcaatttcataaatgacgtttggcgtgtttccgtaaagacttgacatttccttaaaaaattcttttgccttctctttatgttggtttgggttgccgtcatttaagatatgccagtcaatgatgacatatatcccaagttcttttgccgcttcaaccgcttcttttactttatttttcacggacggattatcaatataaccgccatctgccgtatacatcgccgcgcggaaaacggttatgccccaatcgtctctcagccattttaagctgtctttattgacaaaatcgccataccattgcagtccatgtgaactgatccctttcaattgtaccgctttgccgtctcggtttacgagctgtgttccttttatgctaagctgaccattcttggctgctggcatttttgcccctgctgcagatgccggcgaagccggcaagccgcccattgtcaataccgtaatcaataaacacgtaataaaaatagaaattgaccgtttcatatctgatcttttcctccttcgcatcattttggctcttcgcttcttatgagctcgaactcattgtaaaaatctttctcatgattgtctatcaacctaatttcttgtttttgggaggtttaaaagcctgtcaatttgctctatctctattgaataagacacacctgacacatatagaacaaagaaaactggactgaatcgggactttacacgttatttttcaatcgaatcgaaaaattaaatgtatttccaacgtagacgcgctaaatgtgatgagtctcaatatggcattgaatcttatgattgctgtaaaaagacgagcccttgcccgtccttgttaatttaaggttgatgtaaggttcggattaatacgggttaaggttggagttgtacaataagattgtacttcagtgtgagattcagccagaagaattcccccttcaataaatcatagaggtgaaaaggtttgagagaaaataaaattttgtcttcattatgttacttcagtatattttttgcaccgtttctgtttccgattatcgtctatttcttaagccaggatgatgtgaaagatcatgcgaaaaaatctttatggacgcatctgattccttatttgatttttggaattggcatcatcgcttcaggtttacttggtatgaatgatatcagacatgccgggcctttcctgcttgcgacttatgctgttacattccttgtggcgatctattttttcatttggaacattgtcaaaggaatcaaagtgttttcggaacaataggaaaaaacggttctgttattaatcagcagaaccgttttttgtatagccattatgataattgtatatctatcgttgtcccttctcccgcggtgctgtgaatggtgatgtcccctccgtgcttttggataatatcctttgctatggccattccaagaccagagcctgcatgcgtcgttcctgtatttgtccccctgtaatagcgatcaaacactttttccagctcctcttcttctatccctttgccgttgtccttaattgtcacatgagttcgttctttttgttcaagctgtacaacgatcttcacatcgggatcattgtgaacgagggcatttaaaatgagattcgtgaccgctctccgaatcaatatcgcatcaaggttcagcatcagcttttccaggttcgtttgaagctcaatggacttatccgcatatctggaatcgtttaaaatatcaattaacgtttcccgcagaagcgatacaaggtttacccgttctttatttaacatcacatcgttgtttttcagccttgtcgttaaatttaaatcttccatcacatctttcatatagagggatttactctcaatgatccgggcgtactctctgatctgctcgactgtgagatgataattcggatctttgatgatttctgcatagccttgaatagatgctaatggtgttttaatgtcatgagaaatatgactgatccactcttcacgcatttgttctaatttatctttttcttttttgcttaaagatagttgttccgataagtgattgacattatagaagacatctttataaatgcctttggatttcattttgatcgtataatctccattagctaaccgctggattccttgaatgacacggccgagcggttttgtgagctgccggctgaatagatagccaatgagtaacgcgatcaatgcatctattgataataatatgatggttcctgcattgaacttcgtcacaaattccttggtatcatatgagaggacaaattttccgagagagggatttttaaaccctataaagtaactgtactccttgccgtttactttttttccgccggcgtaaatggttgacaataactgttcatccttatatttatgtaaatttacaatttcaataggcgtatattttttcttcagtcctttaggttctctatcatgataaacatcctgtccgttttcatctaatatttgaatccatgcattctgctcttttaaagctttttggccctctttgtttactgtgataccattgttcgataacgtgacatattgtcggaatgatcttgtgaaagtttccggtgtactttcttcgtcatgttgggtgttcgcctggaaaacgagccaaaacataaaaataaataaattaatgaagactgtaatgacggtcactatgatgacagataccatgtatctgcctgttaatcgccaattcatccttacgcatcctttacaacaaatttgtagcctaaccctttcacagtgacgagaaagtctggttttgatgggacagtttctattttctcacggagcctgcgtatatgaaccatcaccgtattgtcagaaccgaaaaagtcttctccccatacagcttgatagagtgtttctttactgatcacccgattgggatgctgcagaaaataggtcataagcataagctctttaggtgttagctcaatagccgcttcatttttggtgagctcggcttgttgttggtttaattcaaatggccccttttttatcacggttccggtttgagaaggctgtaagtaagagacccgtctcagctgcgctttgacccggtatgcgacttctttagggctgaaaggttttgtaatgtagtcgtccccgccgatggcaagtcctacaattttatccgtttcctccccctttgcagacaaaaagataataggaatgtgtgaaatgtctcttatttgcttgcagatatcatagccttcaccgtctggcagcatgatatccaatatcacaagatcgggattttcttgatgaaattgagccaatccgtcacgggcagttgaagcggtcactacgcgatcaatgccttctcttattaatacggttttgatcagttccaaaatttctttttcatcgtctatgattaatactttgctgtgaagccgtgacatatattgatcactccttgaagtcattgtcattattatacccaatgtccgtgtatcgttaaaaaaccaacacttctcttccacagaaaataagccaattttctttttcgagtaagaaaattggcttattgcgatgctgatgtctctaacgctttacaacaaatgttgtcacgctttgagccggcagatgggcccaaaaatgattatccgttactttgagatccgttccaggttgaagattgctgctgctgctcgtgatccatctggatacttgcgaagcagatccattctgcaacacgaagttttggttgacccctgtgttatttttattaatggcaacaatcacgactttattgtctcctttataggctgacacataaacattcggctcaggatttttcgttgcatcaatccttacatagccagggcgcacaaattttgagaaatgagccatattgtatccgcgtttgctgatcatcccatcttctttcatagggccgtatgatctgcggatgtaccaccacacataagcttgaaaatctccctctaccattgaatgatgaatatgctctgaaacacctaaagcctcaggccatcgatccgccgagttgttatcactgttcggatagtatacttccgtcatccaaaggtccttccccgctcctttttgtttgaaaagaggataaggaaactgactgacctgagtgccgtacaggtgggttccgaggatatccatattcctaagcgcctgcggatcgttcaaaatggggtccgatatatttttcaggtattgaaatgattccggcgcaatcacacgggcattaatggaaccggcattctctctcatgaaacgcaggatttcttgaggcgtccaccatgtccattcgtgagcgtaatcaggctcgttctgcatagaaatcgcatacagattcacaccattactcttcatgaaattaacgaaatcgttaagatgctgcgcgtatgcagcgtacttatcgtatctcagccgcttagctgatgtgtcaccattatgattgaaagtctcaaccatatcgtttggcggattccaaggggaagcaaaaacgattgctccatgtttgatcgcactctttgcagtctccacttctttgtaccaattatttctattttcatctacatgaattcttaaaaccgaaaaacctaactgattctgcccattgccaaaagcggtctcccgttgagccgcagtcaagtctccaatccaagccgggtggttcattcctccaaaaccgcgaatcacttgtctttctgcagatatattaactgttgcatcacttgctgctgaaacttcagtaactcccggtcctaacagcatgacggacagcattgtgaaacataccaataatacacaaattgttttttttacgctcgacatcatttttttcctctccttcatttgtcttttatagacttagaaaacgtacctttgcttatctttgtgtaaactgccagtaatcaacattaaacaagtttcctgtaccagttccggtaaatacaaagaatacgttgtgaacaccggatgcgccgcttaccgcagtttctatttctctccaggattgcgttccgcctgtggaagggacattcaaggttccgacaagcttaccgtttgcactgtctagtcgcacttctatttttccgccaagagcggacgctacatttgctttaaacgtccttgcaccgcctgacccgaagtctgcatttccaacagcaatccagtctccgttatgaatgtttgtgacatgttgattattgaccggcccgccgggtgcagaggaattctcggtcaaaatccgtccgttccaggcaaacgtttccgcttctacccggtgatatggattcaagttggacagctgtttgacacctgcaaaatttgccgctacctcttgcagggagccatcaggattatgcacaagcttatttatatggggagaacggtatcctttgccggccccgtaaagagcggagctgacagtttgagtatgatacaccacataccactcgtttttaaaattgaaaacagcatggtgattgtttccgccgcctccgaaaaatgctcccggatttttcagaaagtgccctctatacgaaaaagaattcataggacttgagctggtcatatagccgatctcacctggaggtttatcggccgggtgcgcgcccccgaaattgatacaataggaatagtaatattttccgttatacttatgcattcccgaatcttcaaacataaaaggcgcatcaatcgtagatgcacttccggcaacactggtcatatcaggccccaatttcatgactcttgctgttttaggatcggcccattgcccctgtgtgggatttgaaccgcccggaacgcctccgccggcatataggtaaccggtaccgtcatcatctacgaatactgcaggatcaaaaagccatacaacaccggacattcctggtgtacttggcgtcaccagcggttttccgatcggatctgtccatgggccggtcgggctgtctgcggtgagaaccccgatacctccgccgccgtttgcgaaataaaggaaaaatttatccttaccgttgatctttttcaccacggctgacggggcccatgatgctcctgcccatttggcaatcccccgccgccattcaccccattggcacccgctgcgggaatcgctccgtgatctgtccagttcaccatatccgctgaagatatgacggatattttattcaaattggcaaatgaattatccttaatcgtgccgtcgctattatattcatagtcatcgcttgacatatagatgtagactcttccgttataggtcagcgcaaacggatctgcgcccagatggtggtcgataagcggatttgaattcccaacatgttttgcaattggagtgcttaccgcattcgcatattccccaggtaaacagctcaataataaagcaagaacaaataaacatacgctgcactttttcatcagcttaacatcctcctgtttccgcatattagatttttaaaaaatatgataacaacaggtcatgaagaatgcgtaaaatgaatgatttttagagtgaaaacgttgcaaatatctgaccctcttttatgaaaaatgccgccgattgcagtcagcggcattttgccctgaatcacttacattttgtcaaacttcgtgtcgccagcaaacgatcctattgacagttgttcttcaagaacaagtccgtgatgatgccgttcttcaatccttttgataagagatcgaattgtatccgtattttcttcaatattgtgagggtcaaagatcgtcacatggtctccttttaatttgtactcaaggtaatgctgtgcggttgattgcttccatcctctatcggtcaactcgccgcatagaaaatgatgaatgttggcgctcaccgcgccggaattgatcagtttattgtgatatgtgagatagcttctgattttatccttaatggaaggaatggttaataattctctgtaataatccggaatgatatccagattccgatgaatgatctcttcggtttcctcttccgaaaaataattcaccgaaacagctcttttagaatcaagcatcataatgtccgatacgatgcgtccgcgcttctccaaggctttggcaacctcaaaagccaaattcgaccccgaggagtaaccgagtaaaacaaaaggccctcgttcctgaatgcctatcatgctttctgcataccggtcgacgatctcttgctcgtaagacggctcttctaagaaatcagcggcatagacggtgcagcggccgtctagtcttttcgccatttcattatagaccagcccgtacccgattaaaggcgggaaacagaacaaagggattgaaccgttctgattcatcttgacgaatacgttatccgtcttggactcgaaaactgccgcttgaatggcgcgtgccattgtttcgatggtaggaaaatcgtatacggcttgataatgcattttgattcccatacggtcgttgatttgatgaataacttgcaatactttgagcgaatggccgccaacgtcaaagaagttatctttaattcccgggtcactgagagctaaaatgttcttccatatctcggccagctgcttttcaattaacgttccgggcgcttcgtattcggttccggtgagcctatttccctcaggagccggcaaagcttttcgatcgattttcccatttgcggttatcggcatcttctccatttgaacaaagtaagccggtatcatataagcgggcagtttgttcagtaaatgacgcttcagctgcgccgtatttaatgaatcgtctcctgacaagtaggcgcacagctgctttgagccctcttcttcaatcgcgatgacgaccgcttctttgacagattccgattgcaataaagccgcttcgacctcgccaatttcaatccggtagccccggattttcacctgatgatcaattcttcctaaatactcgatattgccgtcaggcagccaccgggcgacatctcccgttttgtacattttttcgcctgcagcaaacgggtgttcaacaaatttctcagccgttaattccgggcggttcaaatatcctctggcaagtccctctcctgccacatagagctcgcccggtatgcccatgacctgaatgcgttgatattcgtccaaaatatacgcttgcagagtaggaataggttgtccgatgttgcttctgccctcgttgatttcccgttccgtgatttctttatatgtgacatgaacggtggtttcggtgatgccgtacatattgattaattgtgttaaaggatatttaagcttccagtctttcaagaaggatggatttaacgcctctccgccaaatatgatttttcggatgtttaaattggattcgggatctgctctctcctcctgcatcagttgataaaaataacttggcgtttgatttaaaatggtcacagcttccgattttaacaattgcaaatacctttccgggttttttgctatttgtttcggaacaatcactaatttgcccccatacagcagcgctccgtacatttcccatactgaaaaatcaaagcagaaggaatgaaacaaagtccaagtgtccgatgcgttaaaatcaaaaacatttttgttgttaaataacagacgaaccacgtttttatgttcaatgagcgtgcctttcggattccccgtagttcctgatgtataaatcacgtaggctaattgatttggcatcacgctcagattgagattagatggttcggcgtcgtatgatgacggatcgtcaaggaagacagtatgactttgataatcggtaccttccagaagatgatgttgcaataataagatagagacgttagaatcctcaagcatataatggatgcgttctttcggataatccggatcgatcggtacgtaaacgcccccggctttcaaaatagcaaggatgcctatcaccatctccggtgaacgttccgccataatgccgacaagctcctcggcctgaagtcctttggcaaccaaggttcgggccagctgattggcgcgttcatttactacccgatatgtcagcttcttatcttcaaaaacaatcgctgcttgctccggcgttcgcttcgcttgttcttcaaacaattgatgaatcgtcttttcctttggatactcagccgccgtatcgttgaacttatctatcagaagcgatcgctcatccgctgttacgatatcaaggtcttgtacgcgaactttctgatcgtccgccatttgcttcatgatttgcatgaaatgcgtctgcatccgttcgacacttgcttgatcataaacatcgcggttgtatacaaaacgaatgtcaatttctccatccggcatcacgataaaagtaaagtcataatgtgtatgttcttccatatgaaaatcgagaatgtctaatgcgttgtcatcctgcttcatatgttctatttgtttctcaaccgggtaattctcaaataccataatatgattgatcaactgctgcttttgctcagtttgagcctgaatgtcatacaacggaaatgtatcatatttttgagaagccagtgcctgctcctggttcactttcaatacttgtgcagctgtcatttcaggctgcgtatgaatacgtacgggaatggtattgataaataaaccgaccatggtttcaattcccggaatttctgccggtctgccggatacgaccgtgccgaagacgacatcctgacttccgttatatctttgcagcaataagccccatgcggtttgtatccatgtattgacggtgacttgctggcggcttgcggcccgtttgatttcgtctgagagctgctttcctaaatgaaacgtatgctctcctttttcgtatcctttcgcctggtttgtctggccggaagattgttcttgtaataaaacagtttgcccttcataaccttccaagtaattacgccaataggctgacgcctgtttgtgatcttgttgatcgagccattcgatatatcggctgtatggagtgacggctccccgcttcagctgcctttgctcgagtatcgcataataggtttcaaacacttctttcgtaacaagaggcaaacaccagccatccattaaaatatgatgaaagctccatatcaatcgcgcttggtcttcctctgtccgcaggattgatacgcgcattaaagcatcccgggtgagattgaatccccgcgccttatctcttctggcaaaatcggcaataaactcgctgcgctgatgactgttcatgctgcgaatatcttcaacggccgtttcaatcggtttttgccggaatacaatctgcaaaggctgatctttccattctgtataaaaaagagtccgaagaatgtcatatttttcggccagatgcgctaaactcatcctgaatgcatcgatatccaagaaacctttcagatcaaaagcggcttgttcaaagtaagcttcggaagccgaatcgatcaagctgtggaacaacattcctttctgcatcggggttaatgggtatatattttcaatgtcaccgagatgactcgtttgctgcacaaattgatccagttcaccgatcgttataccttttaacgaaatatcgcttggcgtcaggtgaatttgatcttgagcatcacaatgtgcgatgacttgctgcaggctgctttttaagagatcggcacaggcttccattgtttctctttgatattgtttaccgctatagctgatggccagcgacaatcggccgtctgaaatcatgccgttgatatcaagtgtataggtcaaggggcgattgtcactggctgttttcccgcttgagtaaggggatacttccatcctgccgttccggacatcttgatcaaattgacccaaataattgaaacgtatttccggatgtctggtccattcatgcgccttcgggtgatcggacaaatatttgatcaggccgtaacctattcctttttgggggatctgacgcaaattttctttcactgttttaatccgctccgggatatcctgatcagctttgatttgaagcgaaaccggatataggcttgtgaaccatcccaccgtacgcgaaatatcgagatccggaatgatagactctctgccgtgtccttcaaggtgaatgagaatgtcttcatatccggtccaacgatgaacagcaattcccagaccggtcagtaataaatcgttcatatcggtcgaataagccctgtgagcgttttttaataaacgttcggtttcctcgacggtccattgaacaatgaccgtttccttgtctttggccagaccggtctcctgtccattgtcctttggcaatgtatgttgcggattatgtttctgtctgaaccagtattgattttccgcttcgaattcctgactttctgcataacgattcaactgttcagcccataacaggtaagagtccgttttcttcggaagccggatcgcttctccgttttgaagctgctcataagctgccgctatatcctcaagtaaaatcctccacgatacgccgtcgatgaccagatgatgaaccgcaatcagcaaatgatctccctcttgacaccggaacaatcccagtttcatgagcggtccttccgctaaatgaatggattgctgaatctcatttgaaatggtttctatcgtctgggacacatttttttcttcgcgtaatgagatcacttcaaggctgaacagatcaccttcttcgatcccccgatttcgggcttcatatccatcttctgtcggaacatagaccatgcgcaaagcatcgtgatgctctgtgatcttcttcatgacttcccgaagcttggattcatccagtccctctttccaataaagcataatcgcttgattgtaatggtgtaattccgggtatttctggtcgaaaaaccaatgctgaatcggtgtcagcagtgcacggcctttgatttctccttgttctgcgattcgggttaccggctctacgtatggaacaagctcggagatggttgggtatttaaacaagtgtttgatttcaaacttatacccggcttggtataatcttgaggacacttgaatcgacttaatggaatcgccccccaattcgaagaaatgatctgagattccgacccgttctaagcctaagaccgactcccacaccgcggccagtattttttccagttctgttcgaggagcttcatagttcatgcctgtaagattctctcttggagaaggaagggatttacggtctattttcccgttgaaagtaagcggcatctcttccagctgaacgaaataagcaggtatcatataggatggaagctgccgggacagctcttcacggagctcgcctgcagttaaagcatgttgtgcggtataataggcgcacaaggatgtttccccatcgatttcccgggcgatgacgatggcttctttgatcgccggcagctgaaaaaaagcgccttcgacttcgccgatttcaatgcggtaaccgcggattttcacctggtgatcaatccggcccaaatactcgatattgccgtccggcagccatcttgccaagtctcccgtccggtatatccgttctcctgatgcaatcggatggtttacaaacttctcggccgtcagttcgggacgattcaagtagccccttgcaagcccatcgcccgctatgcacagttctcccgccacaccgatcggctgcatatgttccaaatcagcatgtaatatatacaattgaatgttggaaatcggtttgcctatcggaatcgttgcatatgtttcttccgtctggcaatcaaagtatgatacatcaattgttgcctcagtcggtccgtacaagttgatgatttgagcctggctcaccgacatgatgatgcgtttgaagcctgcgacatgtacaggcttcaaagcctcaccgcttgcaaacacatgtcttaatgacgctaatttttgtttcaacatcccgcttggcttctgatccatggattccaggaaggcatgcagcatcgccggtacaaaatgcagtgtgctgacgcctttttgtgcaattgtatctaaaatcagctcgggattcttttctcctccgcttggcagcagcaccagtttagaacctgccagcgtccaccagaacagttcccacactgatacatcaaaggtgatcgcagttttttgcagaatcgcatcccgctcatccagagggtatttttcctgcatccacaccagccgattgatgaccgaccggtgctcaaccataacccctttcggcttgcccgttgaacccgatgtataaataacataggccagatgatccggaccagcagccggctctacattcgacccgtcttcacaaaagttgtgcggatctttcatatccagcacttttcccgtaaaaggtactctctcttgcgattgattctgcacgagtaacaacttcgtatccgaatcctccaatatgtatcgaacccgttcctcgggatagcccgggtcaatcggtacatacgccccgccggctttcaagatcccgaagatccctacaatcatatccagggagcgttcggccataatcccgaccggctgatccggctgcacgccttcagattgcagtgtccgagcgagttgattcgccttttcattcaattcccggtacgtcagacggctatcctcgtagacaacagccgtttgatcaggggtgcgttccgcttgttcctccaaaaattgatgaatcgttttttctcttggatactctgcagccgtttgattataggcgatgagttgatttgtctctgagtctgacagaatattaagctgtcggatcataaggtcgggttggaataacaaacttgaaaaaacccggtttacatgttcgatcacttgcatcatatactggcgatcataagcttgttcattataagttaactttaaatgaatcgaatcattttcgatggaaaactgaaataacgtatcagcagcagccgtttctataaaacgaatgggatgaagctgatctagtgatacgatcgtatggatcattggcaaatgatttgaatcgtagttcagatttaatggaccggccattttatcgaaaggaacgtgctgatttaagatggctccgttcagcgtatgcttgaattcattaaatatggatttaaatgtgctgtccgcatttatgttttgtttgattaacatgacttgatctaaacgaaggtcttcatcggtttcgtcttcaaaggccggtacacctacaataacgccctcttcccccgtatatttgtacaaaagacactcgattccgaccaggagaaccatataaacggccattggcgatttattcgtcattttcatgatgcgcagggatacatcggagctcaatgaactgtgaatccggttgggttcactcggcgcatcgtgctctattgttgagtccgacatttgaaacgaagggattgcactgggacgatcttccgcatcgaacatgctgctccagaacaactcctgttgcttgaattctgacattaatatccctccagtaagttttagccggctgaccgctgtccccgtaaaaacatcatgccggggacagccggtaccggccttttttagaaattcaattcgatttcgcttgcaaagtgttcacttctatttactttctcacttaattgaatttcttttaaaggaatcgatgggtcttttatgatcgccgacagaatcatggcgtaatctttgctcagcgtagcgatggttttctgtttaaacagcttcgtgcagtactcaaagcttccttgaatctcgtgcggattcatcacgaaagtcagctgtaaatcaaatttggccgccgtatttgtttgttcatatggtctgaccgcgagagagtccaattcgatatccgtttgttccgtattttgcagaacaaacatcgtatcgaataacggattacggcttaagtcccgtttcactcccagtttctcaactaattcttcaaaaggatattcttgattttcataagctttcagcatcgtttcttttgtttccgttacataatccataaaggtcttttctccagccggagccgtacggatggccagtgtattcacaaacatcccgataatatgctgtaaatcttcatgcattcttcccgcaataggcgtaccgacgacgatatcttcctgaccgctgtatttcgccagcagtatgttataggctgacagcaagatcatgtaagcggtcgatccggtcaattcttccatctgtttaatcccctggaccacagtctcatcgagagcgaaattgtatcgcttgccttcaaagcttcgaattcgcggtctggcaaaatctttcggcagctcaaatggcgggagttcctcatgaaatacattcagccaatagttctcctgccttttgatgcgttccctctgctccgcctgctgctgccatacagtgtaatctttgtattgaatccggagcggggttaattctttgccgtcatacaattgaatcagttcttcaacgaaaatattcatagaagcgccgtctgaaacgatatgatgcatgtcaaacatgaaaacatgtctgtcctgttctaattcgatgagcccggcccgaagcaatggagcctgactgagatcgaaaggccgcacgaaattgcggaacagctcctcgacctgctcatcagctgctttgtacctttctatagagaaatccgcctgcggcttgatcacctgcaccagctctccccgaaccatttcaaatccggttcgtagcgattcatggcgctggatcagactttggaacgcagattgtaaacgattcatatccatcctgccttccaatgtcaaaatccccggcatgttgtaacttagttctccgccttcaatttgtgtagacaggtaaaccatcttttgtacggaagatacaggataaacatctttggcttctgcaacagggatttcatccggtccgctggtttccgcgcccgcaatgaccctcgccatttcttcaaccgtcgggtattgaaacacttctctcaatgaaatgcttttgccgaattgcttatggatcttggtaacgagcgtcatcccccgtaacgaatgcccgccgagatcgaaaaagttatctttgacgccgacttgttctaacttcaatacttctttccagatgtgaaccagctgctcttccggctttgtccttggagcaacatagtcaatcccggtctgcaagcctgcttcaggcagcggtaacgcgctgcgattcacttttccattggaggttaacggcatttgttccagttgcatcaggtatgaaggaaccatgtagcctggtatttgatcggagagtttttctttaagctgattgatcggcagtgacttctcccctgtaaaataggcatacaaatcgctttgtccctctgcattttctctggccaggatcaccgcttcttgtacatgctcgatgttgagaagagcggcttccacctcgccaagttcgatccggtaaccgcgaattttgacctgatgatcctttcttccggcatattcaatgtttccatccggcaggtaacgggcaagatcgcctgttttatacatccgctctccgattacaaacggatcggccacaaacttttcacccgttaattcaggcaagttcagataccctcgtcctactccgtctccggcgatgcacagctcaccctttacacctataggcagcatccggtcatgggaatcaacaatatacacacggttgttgcccagcggcttgccgatcggcacgtaaccgccgtcgtcagcggatgccaatgtctccggtacgatatggaagaccgatgcatccacgcaggtttccgtcggaccgtatacattggttatgagcggcattgatgacccgttcgaagcgaacaattcaagcaattgcgccaccgtcgcctgcgggagcgcctctcctccaataagcatgtgccggatcgttaccccatgaaggctgtctgcagcgataagcaattgcaaatgtgacggtgttccgtctgttacgtcaatgcggtgggtgcgataatagtttgacaaggcataaccgtctgatactgatgctttagggacgatatacagtgcatgtccccctaacagtgccgcgaaaatttgcttgaccgatgcgtcgaaatagtacggtgccaacagagacacacgcaatcccgaatcataagcaccgtacacttgtccgcggagcccctccatcaaatgaagtacctggcgatgctcaatcagcgtgccttttggcttgccggttgtgcctgatgtgtaaatcacatacgccaagtgatccggtccggctgccgtcaccagattcgagccatccccgctgttcattcgttcgtcattcagcagtaaaatctctccggcaaaggatacacgatcttgtaaatggggctgtgccagcagaacctttgctcctgaatcctccagaatatagcggatgcgttcctgcgggctgtccggatccatcggcacatacgcgcccccggctttcaggatcgccataatccccacgatcatttccagagaacgttctgccagaatacccacaggctggtcaggctgcacgccttcgcttcttaaaatccgtgccaggcggttggcccgctcattcagctcacggtatgtgaatcggcttttctcgtaaactgcggccgtaagttccggcgtacgctccgcctgctcctcgaacaattggtgaattgttttgtcccttgggcagtctattgccggttggccccatctctccacaatctgctctttctccttcgcggtgatcatctccagcgatgaaagcggcgcctgcggatcattcgcaatcgcctcgatcaattggataaagtgctttgccatgcgttctgcagtttcctgcttatacagcgctgccgcgtaactgatcatacctgtaattccgtcttcattttctgccgcttggaacgtcaggtcgaacttcgccatcgcatggttgtccggataaggggtaaaacgcacatcatcgaggctcaattctccacgttctgtgttttgccatatgaacatcgtgtcaaacagcggatggcggctgaaatcccgggacacattcagcttgtccaccagttcgtcgaatggatactcctggttttcgtacgcttttaatgtatgctctttgacttcctgcacgtactcccggaatgttttttccccgatcggtttcgttcgtatcgccagcgtgcccacgaacatgccgattaagctttccaaatccgaatgggttcttccggcaatcgggctgcctactacgatgtcttcttgcccgctgtatttggcaagcatggtcgtataagcagccagcagcaccatgtacagtgtgctttcgctcttcaccgccaagcctttcagctgttccgtcagctccggtccgataacaaactcgatttgtcctccttcaaagctccgcgcagccggtcttccgtagtcggttggcatatccagcaccggaacctctccgctgaacacatccagccaatacgcttcctgctgcttcatgcgttcgctttgcatatccgccagctgccacgccgcataatctttatactgaacccgcaatgccggcaattcttttccttcatataatgaaacgaactcttcaatcaaattcttgatagatacgccgtctgaaatgatatgatgcatgtcaaacagcagcaaatggcggtcttttgcaagctcaatcagtcctacccgcagcagcggcgctttctccaagtcaaatgcccgcacaaacccatgaacgaggacttccgcctgttcttctttcacctgagtgaattccactgcaaatgggacgtcgtcataaatccgctgcaccggttctccgtctatcaattcaaagccggtacgcagcgtttcatggcgctgaatcagcttgcgaatcgccttctcgacaagttcccgatccagagctccatcggccctcatgacactcggcatgttgtagctcagctctccgcctttcagctgattcaaaatgtacagccgtttttgcgccgaggagacggcatagtattcttttgcgtcaacggccgggatagatgtatatgctgtgtgtttcattccggtaatcgtttctgccatttcttcaattgttggcgaccggaacacttcccgcagcggcaggctgacccccatcactttgtgcagcttcgccgtcagagtcgttgcccgcagcgagtgaccgccgatgtcgaagaagttatctttcacgccgatacgcggaagtccaagcacctctttccagatatgcgccacctgcgcttccgccgctgtacggggagcaacgtattcgccccctgtttgcacgcctccttctggtgtcggcaatgctttgcggtcgacttttccgtttgccgtgagcggaatcgattcaacaaaagcccatttcacgggaatcatatagtcaggaaggtttttggccagatctttccgtaatgctgaaggatcagtcgcttttgagacgctgcagtacgcgcacaattcattttcacccaaagcgtttttttgaataaggacggctgcttctctcaccgccgggtgattggccaatatgacctcaacttctttcggttcgatccggtagccccttattttcgcctgatcatcaatgcggccgatgtattcgatttgcccgtcctcacgcagccttgccaaatctccggtgcggtacataacggctccctctctgaacggatcaggcaaaaatttctctcccgttaaagccgggttattcgcatagcctctcccggtatttgctccggaaatatacagttctcccgcaatgcccaagggctgaagctgtttgttcttgctgatgacatacatattgttatggcatatcggttttccgatcggcggaaattcaggaatatcatctcccggttgaatggtatacgtcgacaccacatgagtttctgacggaccgtaatgattgtgcaaatgcaagccgtgggtgcggagcacttgctgaaataaacgggatactgtcaattgttctcctgctgtaatcaaatgcttcacacagcgcggaaatgaatatgcatagctctcttcgctaaaaagcattttggcaaaagcagtcgggaaaaagacgatgtccgtctgatgtttattaataaacgaaaacagctgagccgcgtcccgctttattgattccggcacgatgtggagtgtgccgcctctgagcagggctgaaaacagctcttgatagcagacatcaaatgccggagatgcgtattgaagcacattggttttgaaatcgatgcctgagtttgtaaattggtcatacagcaaattggccatatttctatgttcaagcagcacacccttcggtttccccgtcgttcctgatgtataaataacgtaaagcagatcctccgctgtgtttatcgtctgcacattgctcccgtccggttctgtcaccgcttcttctatgaatgtgacaatctgcgttgctgcctcggggactgaccggtctttctctgttacaacatgagtggagctgctgttttcaatgatatagcggattcgttcggcaggatggctcggatcaatcggaacaatggcaccgcccgcttttaaaatgcctaaaacagcaatcgctaatgatggtgaacgcccggcgatcacagccaccggctcctgatgcttcacacctcgcttacggagaatccgcgccagtttattggctgtttcgttcagctctttgtaagaaatctccgccccttcgtattgaactgcgatttcttgcggcgtttgtgccgcctggcgttcaaacatagtatgaatcgtttcgtattcaggcttctctgttcccccggaaagcggagtgagcagctgttctttttcttgctgcgtcagaagttccatttcttctattttgacagacggctgctgcaaaatttggtgaatgagctgttcaaaatgtccgcgaatccgctctgcctctgattgtccatattcattttggttgaaatcaaaatgaacggtgagttgttcgccagggatgacaactacattaaaatcgtaatgggtatgttcttctatatggaaattcacgatatttaaatccgcagcatcatggcccttttcgacttgctgctctatcggataattttcaaagatcagtatatgatcaattaagttttgcttttgttccgtttgggcctgaatttcgtataaaggataggtatcgtatgattgggaagccagagcgttttgttgaaccatttgcatcgtatcagcaaaagtgctgtcctcatcgcagcggatgcgaaccggaatggtattgatgaacaggccgatcatctgttctacatcaggaatttccgccggccttcccgacacgacactgccgaagacaacgtctgcggacccgctgtatttctgtaataaaactccccataacgtttggatcaacgtgtttaatgtaacctgatgctgatttgcgatctgctgtaattgttttgtctgttcgtgatcaaatcggcagatcacattggcataggcgtattctttttgttcatgctgctctattttatgaagaagcgtggtttcacctgtatatccttcaagatacccgctccagtaccgctttgccgctccctgatcttggcggtcaagccactcgatatagtcgctgtaaggagctgccgatgacggttctggttccctgccttcctgtaaggcgcgataatgatcaaacacttccttcgtgataagagacaggcaccagccatccatcacaatatgatggaagctccaaatcaaatgatatttgcggtcttccatacggaaaatcgctatgcgcatcagcggatcccgagccaagtcaaatccttttgccttatcttctctttgataggctgcgattgcatcctctctcaggtgctcctctataccacgcaaatctgcaaaatgaatttgcggtgtttgcgttttatagacaatttgtaaaggagtatcgttccagccgctgtaaaaacgggttctgagcacggcgtatgtttcaaataatcgttcaaggcttgctttaaaccaatcaatctttaactctccctgcaaatcgaacgatgcttgttcaaaataagaacttgaggcctcgtccagcaggctgtggaagagcattcctttctgcatcggagtgagcggatacacgttttcaacctcacctgcatgcggcagttgaatgaggagctgatccaattcgtcaatggacatgccttttaacaaaatatcgcttggcgtcagttccgattgttctttatggacgcaatgcgtaatgattgtccgcaggcggctttgaatcgtttccgataaccgcatgatcgtttcttttgcgtactgtttgctgctgtagctgatcgtaagcttcagccggccgtcggtgatcattccgtttatattcaatacatacggtctttcttgatctccgcttgagtctgaaccgcaagaataagaagataattgaaccccatgctgctgtaaatcttggtcaaactgtcccaggtagttaaagctgatctcaggattgagtttcgatggcattccgccgcttaagtaccttgctattccatatccgatccctttatgcggaatttggcgcaatccttctttggtcgtcttgatataatcagagatctctttgcccggatgcgcgtgcagcacaaccggatacagacttgtaaaccacccgaccgtgcgggagatatctatatcttgtataatctgttctcggccgtgtccctctaaatgaatcggaatttgttccagtcctgaccaatgcgatatggaaagacccagagaagttaagagcaaatcgtttatttccgtgttataagcgcgattcgcttgttttaatagcagctccgtttcctctttcgtccattccacagttgctgtttcactgtcttttgcagttgtatgggtttcatgaaaatctttaggcagcggtttgacttcggtttgttcgatctttgtccaatattcctgttcctgttttatggtttcactttgcgcatattctgaaagtctcttagcccataattggaaagagtctgttttttgcggcagttgaatcactcgcccgttctcggcttgcttgtagccgctaacgatatcttccagtaaaatgcgccatgaaatcccgtctataatcaaatgatggatggcaatgagcagatgatctccatttgcgcattgaaacaacccggctttcattaacggcccatcacttaaacgcatactgctttgtatctcatcagctttggcttcaattgtccgtcccggatcggaatcttctttcagattcaggacttctaagcggtacagtccgctttgggcgatttcttcattctgtgcctcgcagccattttccgtagtccggaacgtcatgcggagcgcatcgtgatgttcagcaagcttttgcagggtttgacgaagctgcgtttcctgaaaaccttccggcgcatgcagcatgacggcttgattataataatgctgatctgtcgttatgtgatcaaagaaccaatgctgaataggagtcaggctgacttttcctttgacctcaccttgatcggctatacgcagattctgcttgatatgcggactcaattctgcaattgttgcatattgaaacaagtctttgatttccattttgtatccttgctgatttaatctggaggatacttgaatggatttaatggaatctccgccaagggcaaagaaattatcaagaatactgacgttttcagcgcctaataccgattcccaggcagaaactaatatttcttccgcttttgttcggggagctttatactctgctctgtcctgcagctcgaaatccggagccggcagcccttttttgtttatttttccgttagaagttaaaggcatttcatcaagctcgataaaataagccggaaccatataacttgcaagggtatgagacaattgtttccggagccgggcagccgttgtttgcccgccgcttacgtaatatgcacacaattgtttaaacccgtggacatcctctctggctgtaacgacagcttccttgatcgcttcttcttgaagcagtgccgcctcgatctcgcctaattcgatacgatagcctctgattttcacttgttcatctattctgcccgcatattcaatgtttccgtccgccagccacttcgccaaatctccggtcttatacatcttcgctccgggttcaaacgggtcatcgacaaatttctctgccgttaattcgggacgattcaaatatcctcttgccacaccggcgccgctgatatagatttctcccggcactccgatcggtgcgggtttcatattctcatcaagaacgtaaatgctcgtgtttgccgcagcggttccgatcggtaccgattcccgtctgtcctttgcggcatcataacggtaaatcatgcagccgacaacggtttccgtcggtccgtactcattgcatatttcaacccggccttcgaactgttcatgaatgctgcgggctaaccgggtgcttaagttttccccgcccacaatcattcttcggacagccgtttgatcggcaatgttcatttctttcaaaacctgcaaatgggccggagtcaatttaatgatatccaccctcgggtccctcacaatcgattcaagcagagctgttttatcttctccgtcatagacgatgattgcatttcctgtgacaagcggcgtgaaaatagaagtcaccgtcagatcaaaagaaattgacgaatacaatgggaagttggctttctcgccttttacataaacctctttcgcccaccaaatataattggtcaagccttggtgctcgattagtacgccttttggccggcctgtggaacctgacgtataaatgacatatgccaaatggctcacatcatttatcggagcaaggtcagagccatcttggtgataagaactttcatcatcaagtaaaaccgtgacgccttcataggcgagctgtttcctgacgtcccgctgcattaaaacgattccggcttgggagtcatccagcatataccggatgcggtcttgcggatattccggatctatagggacataggctccgcctgattttaaaacggcaaggattccgaccaccgattcgatgctgtttcttgtgatgatggctacaggctgatccgtctggactcctttcgctcttaacgttcgcgccagtcggttggcccgcttattgagctctccgtacgtgagctgcctgtccttatcaatgacggctgcttgatcgggcgtacgctgcgattgctcttcaaataattgatgaaccggcgtctgcggaaacggcgcggccgtgtcgttaagcgtctgcagaagggttcttctttcgccttccgttaacaattccgcttgatccacccggatatccgcatctgtcacgccttgatgcaggatttgcatgaaatgttcccgaacccgctctatgcttgcacgatcatacacatttgcattgtattcaaaagagatgttcatctcgtcgcccggtataacggtcaaattaaaatcgtagttggtctgttcttccatttgcacgttggaaattttgatggatgttccgttttggcggcctatgctttccatatactgatcaaccggataattttcgaatatcattaaatgtgtaattaaatcttgcttttgcgttgtacgcgcttgaatatcgtacagcgggtgcgtctcaaattgttgagacgctacagccctttcctgcgcctctttcataagctcggcaaacgttgtcccggcttcacaccggaaccggacgggaatggtgttaatgaataagccgatcatggtttccacgtttggaattccagcaggtcttccggatacaacacttccaaacacaacgtcccggctgcggttatatttctgcagcaaaaccgcccatgccgtctgcagcagcgtgttcagcgtgacatgatgctcgcctgccgtccgcttcatttttgaagtgagatcggagcttatgtcacacgtcactttttcaggaacgtatcgtccgtcttccgctgcatggtgatccttaggaaggccggtttgctcctcatatccctctaagtattgatcccaataagccgtggcctttttcgcatcttgccggccgagccattcaatatattgactgtacggagtaattgatgattgttcaggctgcttttgctgaagcaaggcaaagtaattctcgaatatttcttttgtaatcagcggcaggcaccagccgtccatcaaaatatggtggaagctccagataaaacggtatgtcttttcatccgtacgaaggatgaatagccgcattaacgcgcctttttctaagtcgaacccccgcatcttatcttctctggcatactgctgaatcatcgcttctttttgtgattccttcatctctcgtatgtcattgaattgaaaaccgatttttttcgttttgaatataatttggagcggctgatccttccagcctctgtaaaaattcgtgcggaaaatatcatatttttgcgataagccgtccaagctttttgaaaatgaatcaatctccagatctccatgcagatcaaacatcgtttgctgaaaataagcacctgaattcggatcaaataagctgtgaaacagcatgcccttctgcatcggcgttaatggataaatattttccgcttcgcctaattcacgcgtctgctccaaaagctgttccagttcgtcgattgagatatcttttaacaggatgtcacttggtgtgagagaagtctgctgccggcttacgcaatgcgcaatgacttcttgcagactttctttcaacccttgggcaaattgcgccatagtagatctttcgtattgtttgctgctgtagctcagtgtcagtgataatgtcccttcggcaatcatgccgttcaaatcaagcacagccgttctctcttgattttcgttcatcgataaccctgtggaatatggcgatatgcgcaaagcctgatgcttcaggtcttggtcaaattgtcccaaatagttaaacgatatctccggattcagctgcaggctgtcggcttccgggtgcccggatatatatttgatgatgctgtaattcattcctttatcagggatgcggcgcagcccttcttttacgatcttgatccgctgcgacagatcttttccggcttccatcctcaggacgacagggtactggcttgtgaaccatcctatcgtgcgggaaatgtcagcatccggaataatcggttctctcccgtggccttccaaattcacgacaatgtcttccgtgcctgtccacttgtgaacggccagccctaacgaagtcagcagcagatcgttgatatccgtgttgtaggcgcggttcgcttgttttaataattgctccgtttcctcttttgtccattgaatcgtcacttcttcgctgtcacttaataacgatccttcgctgatagtgtccttaggcaatggctgaggctttatgcttgaaagctcagtccaataagcaatctcctctttcatgtcggtttccgccacatatttggacaattgatcggcccagaatggaaacgaatctgttttttgcgggagctggatcgtttgtccgcgttctgcctgctcataaccgcttgcaaaatcttcgagcaaaatacgccaggatactccgtcaatcagcaaatgatgaattgcaatcagcaaatgatctccgtccggacattggaacaaaccgagcttcatcaatggccctttgtctaataccatgctgctttgaatctcattcgctttatcggcaatcgcttgagccggatcggtttcccctttataattcatcacttccagatggtatagttcactttcatctgttcctgtaattcgcggagcgtatccatccggcgttttttcaaaaatcatcctcaaggcatcgtgatgcgacgcgatctgttccatcgtccggcgaagcggagcctctttaaagcattccgccgaatataacatgacggcctgattgtaatggtgtgcatgcggcatgttttgttcaaaaaaccaatgctgaatcggggtcagcttggttccgccattcacttctccttgatcagccaccctgctgaccggcgctacaaactgactaagttcagcaatcgaggggtgtttaaacaaatgcttcatatcaaccttgtatccggcttgatacaatctggatgacacctgaattgacttaatcgaatctccgccaaaatcaaagaaattatccagaattcctatacgttctgcccctaatacttcttgccagatagacgccagcagttcttctattgtgttccgcggggctatgtattcgtattccgcccgcgtattttcgtcagcagcaggcaaagctttcagatcaatcttcccattggaagtgagcggaatgcgttccaatgggataaagcgggagggaatcatataattcggcagttcccgggataattcttttctgaactgcgcagcggtcaaagaaggctcaccgacataataggcatacaattgtttggccccgtctgcgtcttcacgcgcgacgactgcggcttcacgaacgttttccagattgaacatggctgcctctacctcgccgatctcaatccggtagccgcgaattttcacttgatgatcaatccgccctaaatattcgattcttccatccggcagccatctggcgagatccccagttttatacatcttttgaccagggacatgcagatgctccacaaatttttcctccgtcaattcaggacgattgaggtagccgcgggccactcccgctcctccgacatacagctctcccggtacgccgatcggctggatttgatggtgcgctcctaaaatataagcttgatggttggccaccgggttgccgattgtgatctgttcatcagcggactgaacagggtgaaatgtagataccacgctgttttctgtcggtccgtattcattattgatccgaatgcgaggctgcagagaatggagcttctcaactgtatctgtttccagctgctcaccgcctacaacaacatgctgaacatggatgaagtcctctgtgttcatctgttcgatcatcgttttcagaagacggggagaagttgagaaatgagtaattctctcttgttttatggcattttgaatggcgaaagtttctttattctcttcattaggcaataggtgcaaagttgcccccgagatgagcgggccgaagaaatttaaaatgaacgcatcaaaaacatacgggtacaagacaagcacgcgatccgccggagaatgcttaaaaaacgccttcttccattggagcgaattcacaatgccgccgtgttcaaccatgactcctttcggctttcctgttgtacccgacgtataaatgacataggctaaatggctgtgtcccgctactggtgataacaatgagctatcggcatggtatgatgtttcatcattcaaatcaatctccgggccatcaaaggagagactgttttttaaatgacgctgaacaaggagaacgtctgcatccgcatcatgaagcaaatattgaagccgctcttttggatattcaggatccaggggcacataagcgccccctgccttccaaacggctataatggatacgatcatctctaatgaacgatcggcgagaatggcgactaacgtatcgggttgaaccccgcaattacgcaatgttcttgccaaacggttcgccttctcattcagttccctgtacgtcaaatggtcgtttttaaacttgacggccgcatgctcaggtgttctttctgtttgctcttcaaataattgatagactgttctgctcccggagaaatctctgacggtatcgttaaaatcaaacaatagcttctgtttttccgcttccggtaagatctctgccgtgtggatcgcggcttgaggctgaaacaggatcacagacagcagctgatccaaatgggatacaatttgattgatatagcgctcatcgtacaggttgccgttataaaaaagcttcaaatgaatcccgttgttctccaaatcaaagtgaaacagcgtatcggctgcagtatcttctttaaattgcaaggaatgaatttcgttaagcgaaacgacggtatgaatcaacggcagatgctcgtcattgtattgcacgctcagatgctgaaccatttttctaaacggcaggttttgatttttcagagaatcattaacggcttctttcagctgtccgaatacggttttaaatgtactctcgtttgaaagcgtattttttaagaggacaatgttgttaacggctgactggccggctttttgcttcgataccgtcggaatgccaagaatcaggctcgtttgatccgtatatttatataacaagcattcaatacccgccaataaaatcagataggccgccatatcggaatgattcgccattgtcatgattctttgagatacttccggagaaaaggaacggcagatgcatttttcctggtagccggtacgggccaacgacgctttatccgctgctttaaagtaagggaatgcgcttagtccgtcttcttcatcaaacaggttttcccagtacgtttcttggtttttaaataccgacattggagcacctcattttatataatttaaagaaataatgcttttccctaaaagttcaattgaatagaatcaagcgcgttctcttcttcctcattgctgccgctcaatccgatatgttcgattagaatgcttggctgttccaaaatcgccgataggatgtgtaagtagtcgtttgataaaacctcgattctgcttttcttaaacagttttttcgaatattcaaacagtccgtgatagttgtcgcggtccgcctgaatcgacaaggtcaaatcgaatttcgcaaccggatgatgaaatggatacggcttgagttgaagagaatcgaaagtcaattcagcatgatcgagattttgcagcacaaacatcgtatcgaataaaggattgcggcttgaatcttttggaagatgcagatgctgaattaattcttccaacggatagtcttgatttttataggcgttcagcatgttttcttttacttcgtttaagtaggcatcaaatgttttacggcccgccgggtgattgcgaatgactaacgtattgacgaacattcccacgaccagctctacatccaaatgagtccgcccggcagatggcgttcctacgataatatcttcttgtccgctgtatttggataaaagaatcgtataggctgccaataaaatcatatacagtgttgctcctgtgtcttctttcatttggcttaaacgctgtttcaagtgttctggtataagaaattcaaatgattcgccttcgtaatcgcgtatggcaggtctctcataatccgcaggcatatccagtacaggaatatcaccgtgaaactgatccagccaatacgcttcctggctcttgatgttccgtttctgaatgtccgattgctgccaaactgcaaagtctttatattgaatagagagcgggtccggtttgttcccctcgtagattcggcttaaatctttcatcagaatattgacggacacaccgtcagaaatgatatgatgcatatcaaccacaagcacgtgccgcgcaggttcaatttcaatcagtccggcccgcatcagcggcggtttggctaagtcaaacgctttgatgaaatcaagcacacggtcttccgcttcttcttcgcttgcttgaatccgttctatcgtaaagtcgacgttctgatgaatacgctgtgccggctcgccttcatataaatcaaagctggtcctcaacgattcatgacgcgcgattaattttcggaaagcggcgtttaaccgttcgggatcgatcgtcccttccacattcatggcacccgtcatattgtaagtcagctcgccgccttttgtgtgacttaacaaatacatccgcctctgagctgaagaaaccggataatatggcatttcctttgcagccggaatcggtacatatcgatttttgtccatgtgtaacgccttgtcagccaattgttcaatggtaggaaacttgaatatgtctttgagagacagattcacatccagctctttgtgaattctggcggctaaggcagccgctcggatggagttgcctccgagatcaaagaaattatgtttgatccccgcttggcttattccgagcacttccttccataaatctgtcagtttggactccgtctcattacccggcggaacatattcagctgtctgctgcagactcgcttctggtgcaggcagtgccttacggtttattttcccgttggacgttaacggcatatgctccagatggacaaaataggacggaaccatgtagtccggaagctccgatgacaattgttccctaagctgcgcagccgctataggcttgccgcttacgtaatacgcgcataattgttttaagccgtcttcttcttctttcaccgtaaccgcggctttttgcaccgcttccgcgttatgcattgctgcttcaatttcaccaagctcgattcggtatcccctgattttgacttgttcatcaacgcgcccgatatatacaagatttccgtccttcaaccgcttagccaaatcccctgatttgtacatcttcgctcccgggacatacgggttttcaacaaatttctctgccgttaaatccggacggttccaataccctctggcaacacccggtccgctgatatatatttcgccgattaccccgatcggaaccaggtttctgcttgcatcggccacataaatatccgtgttggcagccggagtgccgatcggtacaaattcccgcttgtcccgttctgcgtcgaagtgataaatcatacatccgacgacagcttccgtcggtccgtattcattgaaaatgtccagccggcctttaaactgctcgctgacacttttggccagacgggtgcttaaattttctccgccgacaatcattttccgtattgccgtgccgccagcgatattcatctccttgatgacgtgcagatgtgccggggtcaatttgatcatgtctattcttgagtcccgcataatctcagaaagcacagcgcttttatcttcgccgtcaaagacaatgatggtatttcccgtaaccagcggtgtaaatatcgaggtcacagtcagatcgaaagagatggaagagtataatgggaagttggttttctcacctcttacataaacctctttcgcccaccaaatataatcagccagtccctgatgctcaatgaggacaccttttggatttcccgtggaacctgacgtatagatcatgtaggccaaatcatgcgcatcgctgtccgattcaagattcgagtgattctcatggtatgagttttcctcatccaaaagcacaacgtcaccatcatacggtaattgatccagcaggctgcgctgtgtcaacacaacctccgcccttgaatctctcaggatatattggatccgatcttccggatattcaggatcaatgggcacgtatgcgccgccggctttcagaacagccaaaattccgacaatcagttcgatccgatgcgggcagatgatggcaacgaattgatccgcttgtacgccttttgtccgtaacgtccgcgccaatcggttcgcccgttcattgagctgtctgtacgtataccgctcattgccaaaaataacggcttcatgatcgggactctgttctgcttgcatttcaaaccatcgggttactgtttcgttatgcggacacggcgtctttgtgccattacactccgtcagcagttgatgccgttcggtttcagacagcataggaacggaagacaatgtcatctccggctgctcaacaagactgtttaaaatggcggtatagtgtttggtgatctgttcaatggtgtcttttgtgaatcgtcccggtttataatcaaaatgcatctctatctgttgaccggcatcttcgattgtgagcatcaaatcatacaaagagacccctggatttcgttctttcactttaaatgtacattcattgtgccggatttcatgaaattcaatgttttgaaacacaaacatcgtgttaaacatagactgtccggttgtttcccgctgcacatttaatttctccacaagccggtcgaatggatagtcttggttttcgaaagcgtcaagcgtctgccgctttacttcttccagataatccgtaaacgttctattggcgtgcggcttcgtccggattccaatggtttgtatgaaaataccgatgatcttttcgatatccggatgatttcttcctgaagcaggcgtgccaacgacaatgtcttcttgtcccgtatatttatgaagcagcacattataggcggccagaagcaccgtatagagagtggtttccgccttttgcgccaaatcttgaagcgaacggatgacatccggctgtaaggagcatgtcacacgctgtccctcagaagaccgttctgccgcttttgaaccgtctgtcggcaggttaaggatgggaatttcgtcttgaaattgttccagccaatatgtctcctgccgcttcatagcatcctcattcagccgttggttttgccattctgcgaaatctttatattcaaattcaatgtccggtaatggtttctgatgatataaagccagcaattcatttgtaaggatgttgacggaataaccgtccgaaatgatatgatgcatatcgatgagcagttcggcctgctcgttttcaatcttgatcagctctgcacgaactaacggagcttggtccaggcggaacggttttacaaaccggtctgaataggcatcaaattcgtcccggctcattgtccggacatgaacgttaaaatcaacttcgttttcaagtttctgaacgatatcgccatctataatgtcgaaatacgtgcgaaacgcttcgtgccgctgcatcacttgttgaagagatgagatcagggcttgctcatcgtacttccctgttattgatatttggccgaacatattttgcgccagctgatccggttccagttggtgcaggaaatatactctttgctgtgccggcgatgtcgggtaatacgcttttttctcggcagccttcatcgggaggtgcacgacttttgtttcgttctgaatgaaatgtgctaattccttaacagtctggtgattgaaaaattgtccgatggaaacattttgatgaaatgtcttctgaactttggaaagcataagcgtcgcctggagtgagtttcctcccagagccaggaagcgatctgatctgccgacccgttcaaggccgaaaagttcctcccaaatccgcgccagctgccgctccgtttcatttaccggcgcctcgtaggcttcagtgaaatttgctgtattgcttcctattgaagagacccgcttctggtgttcggcataaagtgcttgtaaatcatgctgttcttcatcggaaaacagcatcatggcgtcaagagggattgaatctccctcaaccattttttgcagcaattttgtaaaacccgctccccactttttcatgatttccggactgatgacgttcgtattaaagtcgaaatcaagaacatattcttgatgcgcgtctgttatgttaagaaataaatcatacagggtgcattttaccgggtatgcaacgggctccgcttccgcctttccgaaatgcagctttcgaaaaggcctgtctaaattaaagataatacgcatatccggcacttgatcgtgcggaagctctctggccaccagtgtcatcgggacggcttggtgccgcattgcaagattcacgctttctttcatactgccaagataaccggttaaagtgctttctgaagtagacgtgttcttcaccggaatcatattgacgcaatttccaatcagatcatgctgtttcatatgcgattgacctgcagcggggaccccgatcacaaggcctgactgtttggtaagccggtgcagaaaaagatgaaatgcacccagcatcgtcacaaatacgctatttttcatctgaatgcttaatgaccttaaagcctcgctcaatggccgtccaagcctgacggtacaccggtctccctcataccccttcggataacagacagaagctgcgctcggcagaattggctgctgtatcggttcagagaaatgacgccgccaataacggaccccttcttcataatggccgctgtcaatctgtgcctgctgccagtctaagtattggcgaaacgaaacatctgcctctttcggtgaaattggttttccttgtacaattgccgcgtagttgctctccagttcttgaacaaaaacggcgattgaccatccatcggcaatgatatgatggaacgtgagcacaatcagatgttcattgtgagccgcagtaagcacatggattctaaacaaaggcttttgttcatggaaatgcaacggccgcttggcatcttctgtcagccatttttgaatttccgactcccgatgttcatgcgggtgaccggtaaaatcaatgactggtatttctatattcatccgttcctgcacttgctgtacctcgtcatcgggatgaatcaccgtacgtaaagcttcatgacggtcaacgatatgccggacggcttgttttaatggcgtatgctgcagttcgccctccactttcagcataatggactggtttaaagcggcggaagcttcattcccgtaatgggatgccataaccaactgcttttgttcaggtgaaagctcgcgcgtcccggactttttacggcctccgccatcaggggaatccgggccttccggaataaatccgcctcggcgaagatcctccaccgtgtctttcaccgcttgaataatattttcgatatcatctgcggtatgcgcgacggacaagaagcagttgcgtccttcccacacatagacacctttatagttgagatggtaaaagaacaagtcattatcaagcgatgagacaaaccggaataaagaaccgaatcgaaccatgcggataggcacttgcgctagttcgaagcagcgattcagctcatcgaccaagtaggctgttttttgattcagctgctcatacagatgttctccctcggtttgtaaatgacgaaggacggctaatgacattctcatggtaagcggatgagtattgaaggtgccggccacaaacgtgcgtttcgcctcgtcttgcgggtaggaatcgtccccatactgccaggtacccccgtcgatcgcattcatgaactcagcttttccggcaactacccctaacggctgtccgccgccgatgatttttccgtaggtcactaaatcagcctgaatgccgaaccattcctgtgcgccgccgagaccgatccgaaatccggtaataatttcatccataatcagagctgttccggattgctgcgtgatcgcccgcaattctttcaaaaatgcccgcggctgcaaatccggtctgcggctttgtaccggttccaccagtacggctgccaattcatcaccaagactgcggatcacgtccagcgaatcgggattgttgtaatgtaaaataatcaaatcatccataaagctctgcagtatgcccggagccagcggattcgcagacgcagctccgccttttgtgccggcaacccctaatacgccgtcaaacgtgccgtgataagatcccgagaacgccacgactttctttcttcctgttgctgcccgcgccaaacgcagggcaaccatgacggcctctgttccggaattatagaaagcgaccctttccaccccggtacatgtgcggatccggtcggcaacttcaccggcgacatctgacatcgggccgagcggaggcaatgatgaacgggttgaatcatcgataacctgtgtaataaaggaaggatgatgcccgaaaaggttaactccgaaccccatggtgatatcgatatattcatttccgtcaatatcccacattttagaaccgtcagatcgttcggcgataatcgggtatacgatttccttccaatacgaacggaagctggacaagttgcggttgtttgcatgagcaaatcgggtgttgtctgtatattgtttggaacctttcgttttatctgcgtacttcttgatgaaatcttctaagtattgtttttgccgtgcggtatagtgtccctgatcatgcaggttctgaggctggaaaggaacatagggtttcgcttcttgagccgctttcttttctgcagtgacggccggaggcccctgcttgacagaaggaattgatttctcttgcgctttagcgtattctttctcatcggaatgatgtccgctgtttctcaacaaattaaagctatttaattgagcttgcaaggtatcctgaattaattgattctgagaagcgattattttttcgagcatatgctcttgatgaccttctctgcgatccgattcagactgtgcttctgaaatgacctgtatttcctgcgccggaacattctcttgaggcggagcggatgcaaaggacgatggaacggtctcagccaagtaatctatgacactttgaaggttgttcatcgtatcaaaaaaacgatccatcgggatgtctgccccaaattcgtccgcgatggcttttttgacctgtgacagcatgatggaatccatcccgagcccgataaaatgagcattcagatcgagttcctccgctctgatccccgaagcattgctgattacagttttcaagaaggattcaatgtgcgccttcgattgattgatattcaatgccgcttctcctctcttttcgtcctcgtttaagcgcaattggtcagcttcagcccagcatcggctccgttcaaacggatacaggggcaatggcgtcttttgtacagtttcaccggaataaagcgcgcgccaatcgataacggctccttgcacaaataattcggcggcgcgatgcagccatgtgatccgttcatcttgcgtacgtaaacgctgcttaatcagtgcggctgcttgtttattcagctcttctttatgagcgggcagcatttccttcatattcttgtagccgatgtatacaccgggaaggtttctgtctccctgaatcaggcgggtcagcttatccgatagttcttgtttaccggatacaatcatggcaatgccatgatccaaatgagccctgcccgtactggctgtatagcaaatggactttaatgaagcttggctgtcatccgatacatattgccggtactgctgtgcgagttcatagagtgatttttcagtatgagcggataaaacaaataggtgcggcccatgttcatcctcgggcgcatacttactttgagaaatatattcttccaataccacatgagcgttcgtcccgctaaagccaaatgagctgactccgcctcgcagcggctcttcaccggatgtgaacgctgcagcttcctggtttacgtaaaatggtgaagagtgaaaatgaatgagcggattaggttcattaaagtgcactaacggcggatttttcttgtgattcagcatgaggacagatttgatcagcccgacgatgcctgccgcttcaaacaaatgaccgatgttcgatttaacagaaccaatcgcacaaaattgtttttttgccgtatacttttcaaacgctttacaaagcccgttaaattcaaccggatcgccgagcttcgttccggtgccatgcgcttcgatgaaagacagtgtttcaggggcaatgcccgcgtctttccaagccgtctcaatgacctcagtctgagctgccggattcggtgctgtaatcccggcggttgttccgtcttgattcagcgcgcttcccttgattacgccgtaaatatggtctccgtcgcgaacagcatcctgcagaggttttagcaggactgcggccgcgccttcacctgtgccagtaccgtctgaatctttgctgaacgttttcgtgtacccgtccgaagattccatatcaagtccgatacagatcggcaagagcgatgtccggataccgccggcaagagccatttcacaatcgccggatattaaagatttacatgccatatgaaccgcggcaagcgatgaggagcatgccgtatccactgtgaccgccggcccttttaaatttaggaaataagcgattcggctggctaacacggaagggagattgcccacgatatattgatgaagctcctccggataattcgcagaaaggagacgttcataatcgtagcccaccttcgagtaccctgcatataccccgacacggctcccgttcatgctgccgccggcatagcccgcatcttcaatcgcatgccatacagactgcaaaaacagtctttggttagggtccataaactgagccgttttaggagctaaaccgaaaaacgagtaatcaaagcggtcgatttcatctaaatagccgcccttcacaaactgattctcattgatttcgctttggatggactttaaataatccgccgcatctttcagccgggatgcagggtattctcgaatgctgtgctcacctttttcaagcagattccaaaaatcacttttcgttgatgctcctgggacattgagcgacatcccgataatggcgatatctttcggcgtcacatggcttggtttcgctgccgcgtcctgcttgatttcagcccgtctttcagacagatatgccgctaaatcagtgatagaaggatacgtaaagagatctgaaacagcaagctcgcgtccgaatttctgttctatgcgctcggcaatctgcgataactgtaatgaatttgctcccatatcaaaataactgtcagcgaggtgaacctttttcccattgagcacatcggaaaagatagacagtaattccgtttcaatttcatgaatgggagtctgtccggatgtttccgggctgctctccaaacattcattgatagcggcagactctgttgcaaaattccctgcctcatactgtctggcaagttcgtagcgtttaacctttccgctggttgttttagggagttttcggatcggaaggacttcttttatgctccagccgccccgcttgagcaaatgcttttttatctctttgacaagcggtgcgaatttttcaggtgattttttgtaaacaacaaagagcacgatttctccgctttgtgtcttttgatcatatacaccgcaggcggcaactcttcctaagtcaacctcttccatttcaatcgcgacccgttcaatatcgtgcgggtagatattttttccgttcacgaaaataatgtccttttctcttccggttacgactaagttaccactttcactaatgaatccgaggtctcccgtttttacccagccgtcagaagtcagcgctttttccgtactctcggggttgttataatacccttgagtcacattgtctcctttgatctggatatggccgatgattccgtcttctactctttcatttacttcatcggagatccgaagctgacaatagtcaataggttgtcccacttcgacgaatgaagcgcaattttgatcctctttgcttacttttacagctctttcaccaagatttaaatagtcacgatgcaaataaacgggaacgaattctttacctaatttagagaatgctgcgccgaccgacgcttccgctaaaccgtaaacattcaaaatggcggatcttttcagattgaatactgcgcatcttttcaaaaattcgtcacagagctccggcaatatcggttctgcaccgtttgcgatgaccttgatgtgggataaatcccagtctggttcgtttttcagaaatttaaggaagtagttgtacccgaaatttggagaggatagaatactggctttatgttcatgagcttttttcatccaaagaataggtctgcgaataaataattctgtaggcattagattttgattgattccggttatgaagggaacaaggtggcaggcgatgagccccatatcatgcgttaaaggcatccatgataagaaagagtctttcgaatgaacggctagggcattcccaatggcgcacgtgttatgtattaagttgtgatgcgttaacatgactccttttggatctcctgtcgatcctgaagaaaattggataaaggcgagttcatccgcatcaggttcataaaacgaagcggggtaatcgtaggtttgatcttgaatgatgtcagatttttcgtttaattgatgatggaaatcctgtaaatcgtgttctgcagcatatttctttattttgtccaatactttttcagaggcaatcagaaacgggtgatttaatatgttccaaatgcgccagaccttcagcttatggtcatcatcttctccgatactgaccggcaccgggatcattcctcctaatatacaagcccaaaaagcaacgacaaatgatttgttttcttggatttgaaatacgatttcctgcttcggctgaatgccgatatgctgtaaatagccaagatacccttgcgcctcttcaaacaattggcgataagagacaaccgtctcgtttttatcggattcgataaaacggatcccgcggtcagagatattgcttctttcccgaatgacatctactaaggtttggaattgactggtatacataggtcccctcctgggcgctttattttaaaatccgcaattcttcccaatccggaagctgtttagcctcgcaaattaatttgcataaatggatcgaatgttcgagctcttgttctgagagctcattttcatgtctttccattctctctttcagctcttggatttgcgtaaataatgccgtcgtcatattggaataagccgctgaatccttgttgtaatttcgcgcaatgacggattgaatcatcaatttattcagttgttttttgcgtaaacggacaatatgtttctttctttctgctgaattggaaagcaagtgaacatcagatgtctgtcctaagggataaggtacaatgtgattcgttgtttttctcagcagaccggctaagacattgttcggacccatttcgatgacttccgtcactccgtgtaaaagcaagtaatgcatcgattccgtccatcttaccggcatcgtcatgtgctgctcgagatgttcgctgatcgaatttccgctgctgtaagggcgtgcagtgacatttgaaatgatcggccatgcggcatcccggaaggaataccggtgtaatacagtctggaattgttcagatgctgatcgtatcagcgaactgtgaaaaggcgcactgacattcaaataagtgtatgccgctcccttttcctccgccatcttgatgacacgttccacagcttgccggtgtccggaaatcacatgttgctgttctgaattcatgcaggctactcctgccggaaagtcttccgtcgacactttcgaacatatttcctgcaacgtttgaagagagaggtgagtcacggcggccatcgtcccctgctgctgagaatccgcattctgcataagaattccccgctgccttacaagtgtaacggcatcctgaaaagaaagggcgccggcacagacaagcgctgaatattcgcctaagctatgacctgccaggaagcggggcttcacccctatttcctgcatatacacttgaaaagcaataacactgaccgttaaaatagcgggctgcgcgttcattgtctttgtcaattcattcatatctccgttaaaacacagtttttttacatccaaggagatcgcatcgctcgcttcttcaaacaatctctttgcgagcacaaaatcattccaaaattgtttgcccattcctacaaattgagacccttgtccaggaaataaaaaggcaagattgttcatgagattcctccgatcatattgaacagaaatacaatatcctacaaattatccctttatctaacatcctagcatgattataacaaatgtgtatagaatactttcggaggagttattgttcgattttacaaacgaattagatatatttattcataaaataaaacatgagggtttcaccgaaaatcagtcttaaagagagatgatgaaaagccggagtggagcctgttaccggctcttcttcacttaggacgagctcttcatgtttcatatgttttagggctattggcattattgtgtcagaaattacatattttctgtttattgtaaaaattcatttgtatatctgtgaaggattgtaaactgatggcgtttgattataaatgcggtgcaagagatggatctggtgaggaaaatctgcaaggacaaaatacgccgcagaacaagtaaatgacccagcccggataccgattgacgcagtgaatcggcctattgagtgaacaaggttttcaggcataaaaaaacagccgttcagagcggctgttttttaaatagtacaagaactattgagcggtatacccgccgtccatgactacggcctgacctgtgaccccttttgctttgtcgctggccaaaaatacggcgtaatcagcgatttctttcactgacagcagccgtttttggggaacgagcggaaagatgacgtcctcaagcacccgctcgtacggtacattccttgttgcggaaatgtcctttaattgattgcggacaagctgagtgtccacatatcccggacaaagcgcattgacggtaatgccgtcagccgcgccttcaagtgcaccgactttcgttaaaccgatgacgccgtgcttggcgctgttatatgccgctttcccgtgaaaaccgatcagcccgttgacagacgccatattaatgattcgtccgaattgatgttttttcataatggggaatgcatgcttcattgcgataaatggcgcagtcagcatgacacgaatgagccgttcaaactgttcggtgggaaattcctcgatgggcgcgacatgctgaatgcccgcattattcacaaggatatcgagacgtccgaattgtttctcgaccgtctgcagcatgtcggccacttgcttttcatttgttacatcgcatgtgatgctgactgcctcacagccttcatctttaagtcctgccgccgcttctttccccgcttgttcgtttacatcagagatgatgacggctgctccttcacgggcgaattctcttgcaatttcaagcccgattcctccggctgctcctgttacaacggctgttttttcaataagcaatgaatccatggcggcacctcctcattttggtctgaccccgttttttaacgactggctgacagtaaaatgaccttctgttttctcaaagacctcctccattgttacaccttcctgcagttcggtgagcgtcatacggccatcatgaaaatcgaatacagccaaatctgtgatcagccgatcgaccacctgcctgccggttaaaggcagcgtacattccgttctcactttagattccccatatttattaacatgctccataatgacaataatccgttttgctccgtgcaccaggtccatggcgccgcccattcctttgatcatttttccggggatcatccagttcgccaaatctccccgttcggacacttccatcccgccgagaatcgctacatcaatgtggccgccgcgaatcatggcaaaggattcggcactgtcaaaatacgaggctccctttacctcggtaatggtttcttttcccgcattgatcagatcggggtcctccgttccttccgccggataaggcccgatcccgagcaagccgttttcagactgaagcaggacgttataatcattcggtatctcattggctacaagcgtcggcatccctatccccaagttcacattcattccgtcctttatttcctttacagcccgtttgatcattcgttttctgctatctctcattctgtcagcctcctttatcatgcttgccggacggtgcggcgttcaatccgtttttcatgaatcccgccaagcagcacgtgctgcacaaaaatacccggcgtatgaatttgatcgggatcaagctctccggcatcgacgatttcttcagcctctgcaatcgtcactttgcctgccattgcagcgagcggattgaaatttctcgccgtctttctgaacatcaggttgcccagaggatcggctttccaggcctttacgatggcggcgttccctgtaatccctttctccagaagataggtgcgcccgtcaaatgtcttatgttcttttccctcggctactgatgttccgacgcccgcaggtgtataaaacgccggaatgcccgcccctcccgcgcgaattctttctgcgagcgttccttggggcaccaattcgacttccagctctccgcttaaaaactgccgttcaaaggttttgttttctccgacataggatgcgaccatttttttgatctgccggtttgcaagcaagaggcctaacccccaatcatcaacaccgcagttattactgacaacggtcaagtttttcacgccgctgtccctgatcgcgagaattaattgttccggaatgccgcacaggccgaagcctcctgcgatgagggtgtctccgtccttgatcagtgcagcagcatctttataagagtccatcacttttccttttcccatattcgtttcccctttctgttttggctacacaaggcccgtcagactgtaaatggcgatgatgacaaacacagcggctgttttaatgacggtaatggcaaagatatccttgtaggattggcggtgggtcaacccggtgaccgcgagcagtgtaatgacggcgccattatgcggaagagtgtccatcccgccggaggccatcgaaatcacccggtgcatgacctccggtgggatgtggaatgtattgattgcttctgtatacgctgctgacatcgtgcttaaagcgatgcccattcctcctgatgccgatcctgtaatcccggcaagcgcagtggtcgtcaccgctccgttgacgagcggatcagtaaacgtctgcgatatgccgctgctgaccattttaaagccgggaagcgccgcaatgatgccgccaaatccgtattcggctcctgtattcatcgacgccagcaaggcacccccgatgccctcattcagtccttctttcaaattaaagagcacttttttccaatcgaacaaaatcgttgtcatgattccgatgaacagtgcgagttctactgaccagatcgcagtgacggaggaaaggtcaatcttcccgaacgcttctaaaccgagctgcgcaaaatcaaatccgtcagggtaccaatgcgggagccacatcgtgaagcatttgttcatgactcccacaaggataagcggaacaaaggcgagcacttgccgcgcggggctgggttctgcctcctgcggtaaaacaggcgtatgtttttcattagccagacctgagggttcctctgcagcggaaacttcagattgaaatccagcatagccttctccggcattggccgcttttttgcgccgggattctaaataaatcattccggccgtaagcacaaatgctgcaccaatcagtccgagccagggagcggcataaatgtttgttttaaaaaaagctgtcggaatgacattttgaatttgcggtgtgccgggaagcgcatccattgtaaaagtaaacgcgcccaatgcaatcgtaccgggtatcagacgcttgggaatatcagctttaataaataggtttttagcaaacggataaatggcaaacaccgctacgaagagactgacgccgctgtacgttaaaatcgcacccattaagacgatggcgagaatggctctttttgctcccacaagcctgacgattgtttttgcaatcgactcggcgagcccggatatttcaacaaccttgccaaaaacggcccctaaaagaaatacgggaaaatacagcttaataaatcctaccatcttctccataaatatattcgagaagaaaggaagtacgaagcttggatctgtaagaagcacggcaaacagcgcacaaatcggggcgaataaaataactgaaaagccccggtaagccgcaaacatcagcgtgcctaatgccaataaaataataacaatgtccacaaatccccctcttttctgctcaaaattagtaagcgcttacaaaaatcgagaaaataaagcaaaaaacatgccgattttgtacagtttctgaggctgaaaaaatgtgcatcatggtgaattttccgttttggcgagagaaaaggagacccttgctgcatgatattgattggctgagcagtgagttttttagggacagtgagatggatcagaaaggatttttgctttataaatatgtattcttttttctttcatttatttcctgcaagaggaaccgataaaatccggccctcctgcatggtcattcagccaaggacaaccggaagctctttgagcgacctaaaaccaatgagcttccggtattcaaggcggtgtgcggccagccgaagcttaggcatccgctcaaacagtgtgagaattgcaatttgtgcttcgatgcgcgctaatgaggagcctatgcaaaaatgggcgttctttccgaatgcaagatgcagattcggttttcttcggatatccattttatgaggctgatcgaatatgcttggatcgcgattggccgctcctaaaaggatatatacctgctctcctttttttatggtcttcccatttatttcacagtcttctgaagcggtgcgtgccgtcagctgcgcggggctgtcgtagcgcagacattcctcgacagcagtttcaataagcgaggggttttctctcagtgcgctaagctgttcagggtgtttcaacaaagtaaacacaccgttgctcatgaggtttaccgtcgtctcgtgtccggctatgacaagtaagatacatgtcgcgagtacttcgtcttttgaaagctgtttccccataataaacctgctgattaagtcttcctgaggatgtgctttccgctcgtgaatcaaatctctgaaatatgcagtcagcctgcctgcggtgtcgcttgctctgactaacgtctttcttgaccgggtaagatcaatggcctgaatgacgtctgccgtccattgtctgaattgatatctctcctctttcggcactccgagtatctccgcaatgatgaggcttgccaatggaaaggcaaactctgaaacaaggtctgcggtttttttgttttggatttgatccaacaagtcatgaaccgtttcttttatacaggggcgaagtgattccgccgtctttgcggtaaattctttacctatatgcatccgcatccgcttatggtctgattgatttttaaataacagcatatcgtgctggatatgcgatagattttgatatttcgttgaagcttccggaagaggaatgcggtttttaaatcgggtgtctttcaaaatcgctgccgcttctttatacccggtgacataccagcccggatgttttaatatggttcctttataaacaggatcaatggcacgcagtttttcataaaacgggtaagggtcattccaaaaatccgaatccgcatggagggacggatgtgcagtcgataggcccgccgtcatcttatacctccgtattgcaggcggattgcaggccggctttcatttcttcaacggattcgacttcaaaccctaaatcatggagcatttgatgatcctctgtttcatgctgccctgcagtcgttaagtaatctccgacgaaaatcgaatttgcggcgtaaagtcccagcggctgcagcgaacgaaggttgacttcccggcctcctgagatacggatttcttttgacggattgataaaacggaataaggcgagcacttttaggcaatacaccggatgtaattcgcttaccccttctaacggagttccgtcaatcgcatgcagaaaattaaccgggatgctgtcggcgtcaagcgcttttaagctgttcgccatatcaatgacgtcctgtttcgtttctttcatgccgacgatgacacccgaacaaggcgacatccccgattgtttcgccgtttccactgtattgaccctgtcgtcatacgtgtgggaggtcgtaatgtttgagtgattcctttgtgatgtattgatgttatgattgtaccggtctactcctgcctgtttcaggcgctctgcctgttccggcttcagcagaccgaggcatgcgcagatttttaaaccgtacgtttctttaatttctttgacagcatcaacaacttgatctacttctctgttcgacggtccccgcccgctggcgacgatgcagtatgtccctatattcaggtcgtgggcgcgttttgcccccttaagcaatatatgcttatccaccatccgataagactcgatcggcgcttttgatattgaagattgtgaacagtacccgcaattttccggacacaggcctgattttgcattcataatcatattcagctttactttttttccgtaaaatcgttttctgatatgaaaagcggcatgcatcagcaataaaagatcctcatcaggacaatttaaaatggccagcgcttcttgattcgttacttccgccccgtccagcactctctctgcaagatccatccattgattcatgtttatctccccatttgtgtcagattcatgaaagaggaaacatctatatgtttctcaatcatgtgttgaatgttttccggtgaaacgtgatccagcttcggtgtgattcccaaaatcggaactttgcataatgtttcaatcatgctcgggtttgtcttctcgtccagccccggcctgttccttacgccgttgatcataatgccgagaacctctattcccatgtttttcgcatattcaacggttaaatatgtgtggttgatggttccgagatcaggcctggcgacaatcactgccggtaattccaaggcttttatcagatcactgactaagtaattttcaccaagcggaacggaaatgccgcctgccccctcgacgatgaaacactcatgacgatttttgatcttactccagtgggccatgacttcatccatgctcacggattccccctcaagcaaggcggccgtgtacggcgcaagcggctctttccattcaaatggcgtgatttcttcatgagacagtgcggtttgtgacatgtttttcaacagcgaggtgtcactttccggatgagtccgcggcacgccgcttaaaaacggcttaaacactccgatatccgcctgtttctgcctgaatgccgcggcaagtccgcaagaaacgatggtttttccgacgccggtatcggttcctgtgacaaaaaaacttctcatttgtttatattcagctcttttctaatggaatcaaatgcttctgtcagctcgtctatgtcctgtaagctgcgatccgccgtaacggtcagcctgattctgctttcgccttccggaacggcgggcgggcggatggccggggcgcagattccctttttctccagcagcgcagcggctgaaaccgctgtttttgcatcaccgatgataacggggataatcggtgtatccccgcctcttacgataaagcccatatcggccagacgcgtttttatctttttgacagacgactgcagctcacggcgcgtatcgtgcatatctgatatgaggtcaaatgccgtatgcgaagccgcacaaattgacggcgggagggccgtctgaaaaataaacgtcctcgcctgattcagcaaaaaatcaatgaaaatgtttgatcccgcggcaaaaccgccttccgttccgactgctttgcttaatgtgccgatgacaacatcaggacaaacaccgaaatagtcactggttcccccgccgttttccccgagtacaccggttgcatgcgcgtcatctgctatcacaaatgcctggtactgctttgcaagcgccattattcggtcaagaggcgcgatggtgccgtccatgctgaaaacgccgtctgtgacgataaagcggcggttccgagtctggacggaggcaagttttttctcaagatcagccatatcaatatggcggtacacgatggtttccgcttttgataaacggcagccgtcaacaatgctcgcatggttcagttgatcgcttaaaatgacatcgcctttttgaggcagtgaggcaagcacgccgatattcgccaagtaaccgcttgaaaataataaagccgcttccgtctgtttaaagtccgcgattgtttgttcaagtttttcgtgccacacagtatttcctgtcgttaaccgtgagccgccgcttcccgctccgaaccggctcagcgctgtttgcgcggctgtgatcagccgttcatcttttgacaggcctaaatagtcattggacgcccaggtctgccgcttttgccccttggttttaagagcggtttcctgtgttcgcagcgtccgatacagcccgtctcttttcactgcatcgagccttccgaggagccatccgtcaaaatccacggccggtcacctcggctatcgcttctttcataatggagatcatggcttgtaactggtcggttgtgctggcgagcggcggaagaaaggcgatgacgtcaccgagcggccgtgtcagcatacccagctctctcattttcaaggacaccttgtaccccatccgcttttcaggcggataaggctgttttgtccccttatcctgcacaagctctatgccgcacatcaaaccgagctggcggacatcgccgacatgaggaagctgcttcagatcatgaagaaatttcgcagccgtttttgatttttcggcgactcgttcaacgatgcgctctgattcgaataaacgcagattttcaattgccgcggcacagccaagctgatttcctgtataggaatggccgtggaaaaatgttttcattttgtcgtagtcatcgtagaatgcttcataaatggcttctgtggcaaacgtcacagcgatcggcaaatagcctcccgtaatgcctttccctgccgccatcaagtccggctggacattttcatgctcacaggcaaacatttttccggtgcggccgaaccccgtcgccacttcgtcaacgatcattaacacatcatatgccgtacacagctttcgtacgcctgccagaaagccttcaggcatgacgatcatcccggatgcgccttgcaccatcgattcaatcgtaagtgcggcaatctcttcgtggtgctttgcaagcagctgttcgagcgcgtgaaggcattcatcccggcactgtacggggtcaccgctttcagatctgtatacataaggaatcgggactttgtagctttcaaacatcagcgggccgtacacatggtggaagagttcaatggagccgacgctgacggctccgatcgtatcgccgtgatagccgttctgcatcgaaataaacgtctgcttcttaggtctccctacgtttttccagtattgaaaggccattttcagagcgatttccattgcttccgctccgctgtcggagtaaaaaacgcgtgtcagcttttccggtgtgatgcccgtcagcatctccgcaagttctgttgcgggaacgttcgtcatacccagcaaagtcgaatgagcgattttttcaagctgtttttgaatcgcttcatccatttcttttttgcggtggccgtgtacattgagccatactgaagaaaagccgtcataatattctttgccgctgatgtctttcagcatgatcccgtttccgctttcaatgattaacggatcttcatcgtaatctttcatttgtgtgaaaggcagccaaagatgctgtttgcttttttcaatcattgattgtttcatatgttctcctcccgctgaatgaatacaggctgcttctctaaaaaatggatacagctctccgtatctatggagccatcagtaaagaaaacccggcatccgctttcatctccggcattcttcatcttggcaatccgctgatatcccagcttctttgcggcaacgtagcctgttatgtaatcagggtcatctgaccagcacaattcggcaataattcccggatgtgcgcaaacttttgccgcgatggcatgtgcttcttttattcgtgaattttccggcatgttgtgagtaaaagcccatttttgaaaatcatgtgacggccaatccactcgggatacccgcacacctctattccctctgcagtcaatgcgttttcctgcccggatatcaaacaggaccgctcctcttgcttctgcatattccgcaatgttttcgtacgctttctcgatcatgtgcggaggaatccccgccttttgcagaagcttgcgggcgattgcttgtcctttttccggcgtgtctgtttgatggaaggcaaccggcaaagggcggatcgtttcgatcggttcatgaacgctttcaagctgaatctgcataaaatcaggtatccctcttgagtgcgagaagcctttatgtaataagccatctaccgcttcctgtaaaccgctgtaagtgatgagccgttctccgccggaaatgtgttttccgccctgctcatggggggcgtttcgggaagctctcattctgacgctgtaataggtctcttcccgcatgaaatttccctcctttctttcactttgaaatttaatgttaaccaaaataataaaaggttaacacttatacagaatattagtgtttcacgcttaatatgtcaacctaaactacaaaactgttaacttaatgagttttacaaagcctcattacgttttcatgttttgttcatattttagtaattgtttattcaacactgtccgctaaagtaatccatatcaacaaataggacagcgatccgcatcttacttatgaagggaggtcaaaaccggatgccgttatgctgaaagaaaaagtaaagacagcaggccgtttttgcaccgtgggcgccggcaatacgctgatcgattttggtgtcttctttcttctcaccgcttgccttgtcccctatctgccggcgcagatctgctcctattcggcagggatcatcaacagctatgtgtggaaccggaagtggacgtttcgtgtaaagcgcaaggctggcgggaaagagatcgtgcgctttctcatcattaatcttgccgcgtcgggaatcacctttttgctgctgtacgagtttcaaaaaggcggctgttcgcttttggtgagtaagctcgccgccactatcggcggaatgatgatgaattttatcggaaaccgaatctgggtatttggagattcgctgaaaaacatacaggatcaggagtgaagatgaatgagaaaaaaagtgagaaaagcggtcatccccgcagcgggtttaggaacgagatttctgccggcgacaaaggcgcagccgaaagaaatgctgccgatcgtcgacaaaccggccatccagtacattgtcgaagaagcaagagagtcaggaattgaagatatactgattattacagggagaaacaaacgctcgattgaagatcattttgaccggtcggcggagttggaaatcaatcttgaggaaaaaggcaagtcagagacgctgaaggaaatgcagcggattgccgatttggccaatattcattacatccgtcagaaagaaccgctcggactaggccatgcggtgctgtgtgcggagcattttatcggagatgagccttttgccgttctattaggtgatgatattatggtatctgacactcccgctctttcacagctcatagacgtctataaccaacacggcacagaaacgatcggcgtacagcccgtcgatcctgctgatgtcagcaaatatggtattatacagacggggcggcagagcggtcatgtgtaccgggttgaggatctgattgagaaaccggccgttgaaaaggcgccctctcatattgccgtgttgggccgttacatattaacccctgccatttttaaagcgctgaagacgatcggaagaggcgcgggcaacgaaatccaattgacagacgcgctgcgcgaagtatgccgcacccgaagcatttacgcgcgggagcttgaaggaagccggtttgatataggagataagttcggctgttttaaggccggcacggagatcgggcttctgcgggaagaaatgagatcgaaacttttagcttatttagaagaggtgttaaaaagagaatctgaagaaatcgtgcgttaaaaaataatttgtaaccattttgcttgtcaatcagtcatataattgggtaaaaagataaagaggttgtgaacagtgtgggcaattttattagtgaaatattatcctggctgacaagtatgggctatttagggattgcgctcggattaatgattgaaatcattccgagtgaaatcgttctggcttacggaggctatatggtgtcagaaggcacgatcagctttatcggcgccattgtcgccggtgtgatcgggggaacgatcgcgcagtgctttatttactggatcgcccgttatgggggacggccgtttttggacaagtacggcaagtacttacttctgaaaaagcatcatgttgatgttgcggaaaactggtttcgccgttacggcgccggcgttgtgttctcggcgcggtttatcccggtcgtcagacatgcgatttccatcccggccggccttgcgaaaatgcctctttccaagtttgtcatattgacgacgcttgccattattccgtggtctgtcattttcgtttatctcgggtatcagctcgggggacagtggaaagacgtagacagctatgccggaatgtatacaactccgatcattatattggctctcgtatttattgttgtttattttgttgtgaagaaaatgagatcaagactgtgaaaaaagactgcataagaacggctgcgagccggatctatgcagtcttttttatttataccgggtatacggggtgtttccggtgtgtgaatgtcagttgtttggacatgtaagcagtgaggcgtttattgagttcttcccgcaaggaatcagcaggaacaatgccgtcaatcaccatttcagaggcaagccggtaaaggttaatatcttccttatattcatcacgcttttcttgaataaaagccggcctttcttcaggggccagctcgctgattttgtttgcgtagaccgcattcaccgctgcttcaggacccattacggcaatttgcgcagtcggaagcgctaaacagcagtccggttcaaaagcaggccccgccatcgcgtataatccggcaccgtaggcttttctgacgataacggaaagcttcggaacagtcgcttccgccattgcggagatcatttttgcgccatgcctgatgatgcccgcctgctcaaccttcgttccgatcatgaatccgggaatgtctgctaaaaacagaagcggaatatggaatgcgtcgcacaaagcgataaattttgcggctttatccgccgaatcgagaaataaaactccgcctttgacacgcggctgattggcgataatgccgaccggctgtccgtgaatccgcgcaagccccgttattaattcctgcgcaaataacggtttaatctcaaaaaatgagtcttcatcaatgacacgttcaattaaatccatcatgttgaacggtgcgttttgatgtgccgggatgacatctgagagcggtttttcaaaagctttcgggttcttagatttgttgacgggcgctttttcagtataatttgccggaaagtagctgagatatgtctgcgccatcatgattgcttcctgttccgtcggggcgaggagatcaccgcagcctgatacggaacaatgcatacgggcgccgcccatttcttcaagcgatactttctcgccgatcaccatttctgccatgcgcggggaacctaagtacatggatgcattgccttcgaccataatgacaatgtcgcaaaaggccggaatgtaagcgccgcccgcagcggaaggaccgaacaataaacagatttgcggaatgcggcccgacagctttacttgattataaaagatgcggccggctccccttctgcccgggaacatgtcaacctgatccgtaattctcgcacctgcggaatcgactaagtacaagagcggacactgaagcttctccgccgtctcctgaatgcggatgattttttccaccgttttcgcgccccacgagcccgcctttacggttgagtcgtttgccatcacacaaacggttctgccgccgatggttccgatcccggtaacgaccccgtcagccggcagtccgtctgacatgcactcggcgaaaaaagcgtcttcaacggatatgccgtcatcgaataaaagcttcagcctgtctcttacaaaaagttttcccttcttttcgttgcttgcatgatatttcgcggctcctcccttttcaatcgttttgctgcgtgtctgccgttctttttcgtaatccatccgagtccctccatgttttattttcctttgtattcagggggtcttttttctttaaaagcgcgcaggccctcttctctgtcaagtgtagggatgacttgttcatatgcttttcgttcgatttcgagccctgtattgagatctgtctccagacccttgtttatcgcggattttgcttgtctgacggcgatcggcccattagcggcgatgcggccggccagtgcttttgctttttccataagttcatcggcttcacaaacatgctcgatcagcttcatgtcttttccctcttcggcagaaagccttcggccggtatagatcaattcttttgccgcgccggggccgataagccggggcagtctctgcgttccgcccgccccgggaatgattgcaagccctgtttcaggaaggccgaggcccgcccggctgacggctgttctgatatcgcaggcgagagcgagttcaaggcctcctccgacagcggttccgttcagcgctgcaatgaccggctgcgggagagcttcaatggatgcagccgtttcaccgatacgcctgacgcttttcttaacttgttcatgattcatccccgctctctcttttaaatcagcgccggcgcaaaatgtgtttccggagccggtgagaatgacacagcgaatggatggcgagtttttgatgtcttcaatcacacgctgtaaatgatcaatcatttctgaagacagtgagttggccgcatgcgggcggttcagcgtgatcagaccgatcgtttcttgacagacggaatacaagacgcaatctcccatggcttctcctttctcatttcgttctgaatgcctgcaggtttctgcttggcagatctttgcctattttatccgcgatccagtcggcggcataaagaagtttattcatgtccgtcccggtatcaatccccatttgttcgagcatataaatgacgtcttctgtggcggcgtttcctgctgatcccggagcatacggacagccgccaagcccgcctgaggaagtatcgaaggatgtaatccccatatcaagagctggaatgatattcgctagagccgttcctcttgtatcatggaaatggagtgcgatttttgaggcgggaattctcggcaaaagggcttcaagcacggctatgacctgcaaggggtttgccgcgccgattgtgtcgccgagcgatatttcatcaacatccatttcgagcagggtgtctgacaggcggatgacttgttcgaccggcacgttctgttcgtacggacagccgaacacagtagacagataagctctcgtcgccattttttcagcttttgcttcagtaataacccgcctgagctcttgaacggtccggtcaatcggtttgtttacgtttttttggttatgggtttcgcttgcagataaaaatacacaggcctgatcgattccgccttctgcagcatgctccagtccgatgaggttcggaacgagagccgcgtagaccgtatgttcagatctggcaatgccttttgcgacgtccaggctgtcacgaagagccggaatccatctcggatgcacgaatgatgtcacttcgatatagggaaggcctgtttttgacagcatattgatccactcaatcttatcttctgtatccacccacgccgattcattctgcaagccgtcacgcggtcctacttcattgatgcggacatgtttcggacagttcatgctgcacctcccgttttattgaagttcaatcaggacctctccttcatcagtgaaatcaccttctgattttttcacttctttcaccgtacccgctgcatcagcgataatcggaatttccattttcatagattccaagatggccacttcctgcccttcttcaatgacatcacccggcttcacatgaattttccacaggtttcccgccatctgaatttttatgacgctcattttgacgccccctcgttcattgtttgtaaaaaaccggttgttgcctcacccttttcaaacacttctgaatgggcaatttttgtcagcagcggaatgttggttttaatcccttctacatgatattcgccaagggcggttttcagttgttcaatggcctgttttctcgtattcgccgtgacgatcattttggcaatcatcggatcgtaaaacggagaaatgacgcttcccttttcgacggcgcattcgtgtcgcactgacgggtgtcttaaaacggaaaaagacaagatggtaccgggtgacgggtaaaaggtgaccggatcttccgcatagatccgcacttctatcgcatgaccgcggtgattgatatctttctgcgagaaagtcagcgcctgcccggcggcgattttcagctgttcttccacaagatccagtcctgtaatttcttctgtcaccggatgctccacttgcagtcttgtgttcatctctaaaaaatagatttgtttcttttggtcgacgagaaattctattgtgcctgcattttggtagccgatcgatttagcggctttaacggcggtttcaccgagtctttgtcttaattcatcgtcaacaaacggcgacggcgcttcttctatcactttttggtggcgcctttgtactgaacagtcacgttcaaacagatgaacggtgtttccgaaagaatctgcgagaatctgaatttcaatatgacgggcattttcaatgaccttttccatatacattgcgccgtctccaaaaaaggacgcggcccgcttttgattgccttcgaacgctttggccagctcttcttctgaatgtacgatctgcatgccgattccgcctccccctgcagacgctttcagcatgaccggaaagccgatggcacgggcttcggctaaggcggagtgaacatcgggcaatggctctgaaacaccgggaacgatcgggacctttgctttttgcatcgtttttcgggcctctatcttgctgcccatcttggcgatgatatcaccgggcgggccgataaatgtgatttgttccttccggcagcgttcggcgaacaggctgttttctgacagcagcccgtagcccggatgaatggcgtccgctccggcggatttggcggcttctatgattctgtcgatatgtaaatagctttcatttactctcgatttaccgatcggataggcctcatcagcctcttttacatgcagcgcgtcccggtcggcttctgaatacacagctgccgaggggatgccgagacgtttgcaggtgcggataattcttaaggcgatttctcctctgttggcaatcaggacttttttaaacaaatgtgaagcactcctttttcattaagttaatttgagctcttcaatcgttttttcccgcagcttgaatttctgaatttttcctgaggctgtcattggatattcatctgtaaacaaaacatacctggggactttatagcgggcgatatgttctttgcaaaaggttctgatgtcttctgcggaagcggtttgtccgtctttgagcctgacccacgccgcggcctcttctccgtatttcggatcaggcacgccgacgacctgaacgtctgctactgcgggatgccgatataacatttcctcaatttcgcgcggatagatattttcgccgcccctgatcagcatgtctttcagacggcccgtgattttgcagtacccgtcctcgtccatgaccgccaaatcaccggtatgcagccagccgtctttgtctatcgcttcttcggtcgcttcttgatttttatagtaacctttcatgacatgatatccgcgggtgcagagctctccttgttcaccccggtcggcttctccggatgttccgggccgaacgattctgacttcgatatggggaagtgcgcgccccgctgtttccactcttctttcaaacgaatcatccgttcttgtctgcgtaatgacaggtgatgcttcggtctgtccgtaggcaatggtaatgtcggtcatccccattttgccgatcacttctctcatgacttccgccgggcatggcgagcctgccataatcccggttcggacgtgggaaagatcatattcagaaaaacggctgtcatttaggagggcgataaacatcgtcggtacaccgtgcagagccgtgcaggcttcttgctccaccgttttcagaacggccggcggagaaaactgttcgatcggaatcatcgccgcacccgcggaaacacacgccagcacgccgagcacacacccgaagcagtggaaaaacggcacgggaatacataaacggtcacttgaagtaagcttcatgcattctgcgatattggccgcgttatttacgatattaaaatgtgagagcataacgcctttcggaaatccggtcgtacctgatgtatattgcatatgaatgcaatcatcctttttcaggctgtccatccttccgtcaagcgctgcatccgttacagcttcgccatccttcagcaaagaatcccagcggtgcatcccgggcggacttttatcaccgatatataacaccgtccgtaaaaaggggtaacgtttcgaacgcagcctgccgtgctcacaagttttcagctccggaatcagcttattcaccatctcaacataagatgtctgccggtaggaatccatgattatcagggccgagacgtctgaatgcgccagcaggtaatcgagttctgcgatttgaaaatttgtattaatggtgaccagaacagcgccgattttcgccgttgcaaattgcgccgcgagccattccggtatgttggatgcccatatggccacatgatctcctttttcaactcccagcttcatcagcccttttgcggtttgccggcataaccggtcaaactcggcatacgtataacgaaggccgcgctcagggtaaacaaccgcttcatgatccggaaaaagctccgcggtccgctcaagcagctttccggctgttaaatggataagttcagccatatgacctgcccccttccatccctgtcttagtaaacgttttcatttcacttcaaaagctgtcttgcgatgaccattctttgaatttctgatgttccttctccaatctccatcagctttgcgtcacgaagcatacgttcgacaccgcattccttcatataaccggaaccgccatgaatttggatggcctgaaggcaggttctgacggccatttctgaagcataaagcttggcgaatgccgcttctttcgtaaatggcaggttttgatccttcagccatgccgctttaagcaccatttgtctggcaaggtcaatttccatcgccatatcggccagcttaaattgaatggcttgaaatgacgatatcggactgccgaactgcttgcgttccttcgcatatgacagcgacgcctccagtgcgccttgagcgataccgacagccagtgccgcaatcgagatccgcccgccgtctaatgtatataaaaattgtttaaagcctttttcaggatcaccgagcaggttatcggcaggcaccctgacatcctccagcacaagctcggccgtatccgatcctctcacacccatcttgtcgtacggatttgtgatcgtaaatcccggtgtgtctgtcgggacgatgagagctgaaatgatcggttttccggcggagttctttcccgtaacggcggtgacaatgaccgtgcgggcgtaatttgcgtttgtgatccagcatttttctccgtttatcacatagtcatcgccctttttctcggcttttgtctgggtgccgccggcatctgaaccggcattcggctctgtcagcccgaatgatccgagcgcttttcccgaagcaagcggaataagatgttcttgcttttgctgttcagtaccgaaatagtataatgggcttgcgccgagtgacacggctgccgcgtagctcagccccgtgctgccgcaggcttttccgatttcttcaaccgctgctgcatatgaaatggtgtcaccgcccgccccgccgtattcttccggaaacggaattccgagcagcccgagttcgcctatttttttaaatgtgtctatcgggaagacggctgattgatcaacctcatgggctttcggggcaatttcatttttggcgaaatctctgaccatttcgcgcaccatctgctgttcttttgtcagttgaaaattcattaaccttcctccttctgctgctttctacattttattaatgggggtctttattcattccatccaaataaagtctgaacattcggactcatccatcgcaaaaaaactgacagcgcggcaactgtcagttttattaataatggctatttaatcgtccgttttgcggagggacggctctcatggtgaagcctgtcaacggaagtaacgatataggtgcaggcttctttcccccgaatatcagtatctgaaaatgtctgcgtccgtgacgatgtttttctggctgtatccactaaataaggctgctttcccttttctgcgcggtaaatggcgtaataagccgtttttttaccgttggatttcgcatcttcgatatagagtgtatggcctgaagcgttcttctccgcccgtttgacagacggtttttttaaagccgactgtccgagccaaggcatctcgggaattaatgcgggccggctgtacatgtcattgatcaaacggtttttcacatcgagcggattacggtttaaatcctttaaactgaaatgcatgctgccttttatccatgctgatcctctgtttagagtaatctgtcttccgtattcccccgggtcggcccaggccggatcagtattgttgttgattttataagctgcctgcccgatatataaatgcaccggccgattgttcacttcttttccccaccaatccgctaagacgtcatatgccgccgctttaaatccgatactccagtaaatttgcggtgcgatgtaatcaatgtatcctttttggatccattctcttgtatcagcatataagtcatcgtagttccgcaccccggcggccgtttcggagcctgtcgggtcatctgcggcatttctccatacgccgaacgggctgattccgaatttgacataaggtttttctcgtttgatggtttggttgatttcttttacaagctggttgacgttatccctgcgccagtcatcaattgatgcaaagtgagcttttccgtaccgttcgtattccgcctgatcggggaattcctgtccggcaattttataaggataaaaataatcatccatatgaaccgcatcaatgtcataacggctgaccacctctttgattccatccgttataaattgtcttacttccggaattccaggattatagtacagctgttttccgtatgcagcgacccagtccggatgagaacgcgcgggatgatcgtctgaaagcgcattcaaatttgtgtgattcatcgtgatccggtaaggattgaaccaagcgtgaaattcaagattccgtttatgtgtctcttcaactaaaaaagcaagcgggtcgtagccgggatttttgccttgggttcctgtcagatactctgaccaaggcccgtaatctgatggataaaaagcatcagccgcaggcttaatttggacgataacggcgttcatccccatctcctgaacgtcatccagcagcttgctgtattctcttttttgctcttccggtgacagcccttttttagagggccagtcgatattagtgacagacgcgatccatacggctctcatttctctctccggctgagtgccgcttgcttgtgcggatgctgagaacgtaaagatgccggctgtcagtacaacggccaaaaaccatatcatgctaaaacggcagcttttcatgtttttccccctctctgctttacggtattccgaagcattccgggcggtgaatcagaaagcccgctttgctcctctcagcctaaaagggaaagaaaaaagtcctaaagcgaatcaaaacgcttcaggactttttatgttttatggcggcgagcacgtcaatgaccttcgttccgacgccgacgcatgtttcaagaatggcctgcgctccggcaatggacaaaatgaaaataaccggatgcgcatagcggggccagaccaaatagcagatgccgatcaatatggcgcaccagacgcccgcacaccaataacattgcagcatataaccgaatgcggaggaagggacttttttttggacggcgcgcccgttttgatcgacggttttttcttgctttataaagggttttcttatgaattccgtaatcttatcaaatacgatcaaatgggtcagccggtagctggcaagaataatcattacatacgtaagccaagataggttcgtcatctcaaagcctccaaaaaaaactgagtttgattcccctatcttgccctttgacttcttcagtcattctgccggatgttacagattccgcgccaagcgtcttccgctgtttgcgatgatgtccagtatgacctcggcatttttgtgtgcaaactcgggttcaaacatatctttatgggctccctcgccttgatattcctggtagagtcccgttgtggcgccttcccattttttcggctcaggctcagcattttgctcttcctttaagccggcctcgataaaatggaggtttgccgcgatttggccgtcatttatcagttccgcccagtacgtttgatatcgctctgtttttctgatgaccgcttccctgacggcttccgggacattttcggctgttgcgtttgttggctgcggcggcagtgcgtcaagctttctgtacgcgtctgcgataatgacgtcgctgatttctaagcctcgcttttccatcgcttttgcagcctcgaatgccgtattgccgcctgccgaatatccgaagaggatataagggccttccggctggatttctagcattttatcaatgtattgttccattctgctgtcttcttcaataaagttaaaaccgtacacagcagcccgtccatttaatgccgccgccagatctttaaagaaaatgccgaaacctgagataggcggaaaacagaaaagattgcggcctttcggctgattcagtctgctgatatgctgttcggcagcttctgacagtgtgtttgaatacagcttttcagccaattgttcaattgtcggatattcaaatatcatttcaatcgggacgtccatctgctgcctggtcttcagctgatgaatcacttgcaatgctttcaaagaatggccgcccagctcaaagaagtcatcctgtatgcccagctctccgcagccgaggatcggcgtccaaatgtcgatcagctcacgctctacccagtttcgtggcggaacggcttttgatgaagcttttttccgttccggcgcaggcagcccgcggcggtccactttgccgtttgcggtaagcggcatacggtcaagcttaatcacatactgcggaatcatatagtcgggaagcgacctggccaatagggatcgaatggctctttcttcagcatgtgcgcctgtataatacgcacaaagggttgcttcttgtccttcgtctgacacgatgactgcagcttccctgattccatcaatttcagtcagccgcgcttcaatttcggccggctcgatacgcttcccgcgaatcttgaattgacggtcgatacggctgatgtatccgatgcttccatccggcagccagtgtgccaaatcccctgttctgtaaatcttttcttcaggatgaaccggatggctgacaaacgcttcacttgttaagtcaggcctgtttaaatagcctttggcaaccccgtccccgccgacacaaagctcaccgggcacgccgatcggcgcaagtccgccatttttatcaatgatatacgcggttgaattgctgatcggttttccgattgggatcggctgagaaaaatcgtgcctgatttcgtaaaaggtagaaaatgtcgtattttccgtcggcccgtatatgttataaaggctgagattcggacagcggtgtctgaccttattgatgagcgccggggacaatgcttctccgccgacatataaggtgtgcaatccggaaaacatctccggatccgcctgggcaaactggttaaagagcgccgtcgtcaaaaacagaatcgtaatacgattggaacaaagataattgccgaacctctcaggggcaagcattgtcgtgcggtcaaccacatgaaggcacgctccgttcaatagcgctccgaagatttcaaacgtcactgcgtcaaaaccgatggaccctgtcagaatgagacggtccgtcgtgccggctgacgtgtaattgctgtttgacacgagcgatacgacgttgcggttggaaatcattacgcccttcggttttcctgttgaaccggatgtatacataatataggcaaggtcctcaggtgacgttacggtattcagttttcccgcctcagctgtttgtttttcagctgcagccgggatagagatgatgtgagaaaagtcaacgtcagtctcaatccctttttgtaccgttaacagctgtgctccgctctcagtgagcatatcggcgatcctgtcggatggcagttctgcatcgagcggaaggtacgtccctcccgctttcaatacagcgagaacagcgataataaattccggtgagcgttcggcaagaatcccggcaattccttttggcgccaaaccgttttccagcaggatgcgggcgaacgcagttgaccgttcatcgagctcccggtacgtcatcgtcagcccgccggcgtgaagcgcctgatgatccggggttttcttcacctgtcggctgaacaggctgatgatgctttcgtctctttcataaattgttttcgtgtcattaaattcgccgattattcttgatttttccttttgtccgagcatcggaagccgatcagcaggaacatcgggattgaaggcggcgccgcgcagcgcttcttccaagtgtccttttacgctctctatccatacttcgtcataaacgttcgcattgtagctgaatttgatgatcagctcatcgccgggcgctatgatgaggttaaaatcgtagcccgattgttccgaaacattgacattcccgatccggaacggtgcatccgattccttttccgcgtctctcatctgctgctgaatcggataattttcaaacacgatgatatggtcgattaaatcctgtttcagctcagtctgagattggatgtcagcaagcggatgataactgaacgcctctgaatcaagcatttctttctggctgcggcccagcagttctctaaagctttcatcacccgttttaatgcgtaccggcacggtattgataaacagcccgatcatgctttccacgccgtcaatgacggaaggccgccctgatacgacagcgccgaatacggcatcgtccgtccggttgtagcgctgcagcatcaggccccatacagtctgcataagaacagcgagcgtagcgccctcttctttggcgatggttttcagcctgtctgtcagattttgatctaaagaaaacaggagctctttcttacggtagcctttttcctggggacgggccgatattttcgggagtcctgagggtgtctcgcagcctgctaaatatcctttccaatactcagaagccgcgtctttgtcctgatcagtcagccatgtaatatacgtgctgtaaggctttgcgggcgccaatgtgacgggtgagtctgattcaatcgcccggtacatatgcatgaattcctgaaggacgataccgaggcaccagccgtccataaggatgtgatggtggctccagacgcatacatatttttcgtcagccgttttaaacaaagacacacgcatcagcatatccttttgcaagtcaaagccttttaagcggtcacgttccttaaatcgctgtaagtaggcgctctgttccgcttcatccaaatgtgtaagatcttcgcggtgcagccggaattcccgctcacgcagcacgacttggcgggggccgttcagctgagcgacatgaggtaaaaaaaccgttctgaaaatatcgtggcggctgatgacagactgtacgctttgctcaaacaattccggacgaagccggccttttatggtgaagacggattgctcgatatatgcagccccctccttttgcagaaaggaatgaaaaagcattccttcctgcattcggctgaggggataaatattttggatattttttgttttgtccatgtgttcctcccgctcggtttagtggaagctgagtaagtcggcaatatcctgcaaggcttcctcagtcagctcccgatcatcaaagtcactgacggtcttctccgtatcggttttgctgaggcagtgttccgacagtttcaggagataataccggcagctttcggacagccgttcgatcgtaccttgccggaagcgttccgtttcataggaaatgctgacggtcatccggcctttcgccgcaatcgcgctgatttcaagtgactgctcccgtttccatgtatctgtcacatcatctccgcctcccaaaggagaaaactgaaacgcgtcaggctgttccgtttctgccggattcccgccgggcgcatcgaattgtccgagataattaaagctgatctccggtgctttcccgaaagtcatcccggcaagcttcggcggtgttaaatatttgaggacgccgtatccgttccctttatccggaatgcgccgcaatgtgtctttaacggttttcaatgtgcgaatttcatattcttcaagaggttcataaactccgctccggacaagcaccgggtaaatggaagtgaaccaccccactgtcctgctgatgtccgcacctgcctgctccgattggcgtccgtgtccttcaagggcgattttcaaagcgtgccgcggcgaccacttttgaacggcaagcacagcggaagccaacagcatatcttgcgtatccgtattgtaggcgctgtgcacatctttcaacagggcgtccgtttcactttctgtcagagtgaaggataccgtgttccgtttttttgcaggagtttgagatagacctgcctgctcgtaaggaagactttctgtttcatagtgttcaatctcccgccaatactccgcctgctgaagaagctgtctgctttcggcataatcggccagctgctccgtatatgttttgaatgacatggttttcggagggagtgtgatttcctgaccagaggcggcctgctcataagcagaagccaagtcctccaataaaatccgccatgatatcccgtcgacagcgagatgatggacggtcagaaacaagtaatcttctgcttcagagcggaacagccccgcctgtaccagcggcccgttctccaaatccatgtttctctgaagctctgcgacgcggcgttttataacacgttccttctcatgctcatcgccttccgtttctaatatggtcatgttgtaaagctgctcatctgcgaggtcagccggtctgttgaagaggagaagacctttctcttcgtcttttttgcagacaaggcgcaaggcatcatgatgaacggtaatggcttttaacgttttcctcagagcctcttcatctattgaatttgttctcgtcagcatgacggactggttaaaatgatttgcttccttcatgtcttgtgtgaagaaccatttgtgaaccggcgaccacttcacttctccttctgcgggagcttggctgaccggctgccgctctgtacggacataaggagccagctctctaattgtcggccggctgaaaatatcttttacggcgatctgttttcctgcctgatgtaatcgggctgatacttgcagggctttgatggaatcgccgcccagttcaaaaaatgattgatccgcggcaatgttttcagttccgagcacttcgctccaaatcgcggaaagctctttttccaagtcgctttcaggctccgtaaatgcccgtccggtgtgcgcttttttccgcggctcaggaagcgcgcggcggtcaagcttcccgttcggtgtgacaggcagggcttcaagtgtttcaaagaatgccggcaccatataagcgggcatttcatttctgagtgcctgctgcacggtttcactttctgttccttcttctgtcacgatataagcgcatagttccgtttggcctgctgatgcggacagagcggtaacggctgcttccttgacaccttttatgcctgttaaggccgattcaatttctttcagttccacccggtagcctctgattttgacttgctcgtccattcggccgatatattgcagcgtgccgtccggcagccattttgccagatcgcccgtgcggtacatgcgccggttcttgtggaacgggtcttggacaaaggcttgggccgtttgcttaggaagattgcggtaccctcttgcaaggccggaacccgaaatgcaaagttctcccgttacaccgatcggctgcgggtgatccccgtttaaaatataaacgtgtgaatgctcaatcggacggccgatcgtaatgttctcactttgttctatatgtcttgccgctgtagtggcgacgctgttttccgtcgggccgtactcattggcaagctccgtgtgaggacaaactgataaactgcggctgataatgttttggtcgacagcttctccagctaatgtgacaattctgagagactctgcatcccccggctccagtacgtcaagcagtgtacggtacagtacgggaacaatgatcatgtgagtgatgcggtaagatgcaagatagtgtttaatggcaagaatatctcttgcttcatcttcagctggaacggccgccttcgcacctgaaatcagcggtgtgaacatacttgttacaaaaccgtcaaaggaaaatgaaaaaagctgaagaactgtatctttctcattcagatcataaaatccgctgcgccattgaagggttttgctgacggaacgatgttcgaccataacccctttcggcctgcctgtcgtcccggacgtgtaaatgatgtaagccaaatcttccggtgctgataatggctgaaccggtgatgcgtcttgttcttggatatcctccagtgcgagcacttcacctttaaaatgatcaggcacttgatctatcgcgccgtgtacggtaaggagaagcgctgtgccgctgtctgaaatgatatatcgcttgcgttcctccgggtattcaggatctatcgggacgtaggcgcccccggctttccaaaccccgaagactgcggcgacttgttccggtgatcttggtatcacaatgccgacggcggcattcggtccgatctgccgtttttgcagagctctggcgattttattcgaccattcatctaattctttatatgtgaccaacgtttccccgctgataagggctgccgcatccggtgtttttcgcgcctgagtgatgaacagttcatgaactgttttttcaggcagctgtttatccgtcatgccgttaaagtccgaaagaattcggtcccgttccgcagcagtcagcatgctgatcgcttgtatagaagtttccggttcacggacaatgtgttcaagcatcgtcataaagtgggaagcccagcgctgcatcgtttctttccggaataaagacgccgcatattcaaacagaaaatgaatctgtcccccgccttcagaagcctgcaaagtgacatcaaatttggaaaccggacgggacacgttcgcaggctgaatatgcaaaccgtccaacagcaattcctcatgttccatattctgaacgacaagcatggcatcaaacagcggattacggcttgtgtcccgctgcacgccgatccgctccacaagctcttcaaacgggtagtcctgatgttcatacgcctcaagcgccgcctggcggacttccgccaaataatcggtgaaccgtttgtctcctttcggctccgttctgatggcaagcgtgttgacgaacatcccgagaatcggttcaaggtctttgtgcggacgcccggcaatcggcgagccgacgatgatgtcttcctgcccgctcaatcgcgcgagtaacgtattgtacgcggcgagaagcaccatatacaaagtggagctgtgatcccgggcgatgcggtgaaggccggatgccgtttcagcgtcaagcgtgcacgatacgctgccgcccgcaaagcttctgaccgccggacggggcttgtcagccggaagctcaagcaccggaagctctccttcaagccgcttcagccaataggcttcctgcttctggtacccttctttctcctgaaacgaccgctgccagacggcatagtctttatattgaaggcgcatcggcgcaagcgaacggcctgcgtacagctcgctgaattctttaatcaatgtgttgacggacacaccgtcagaaataatatgatgcatatccgttaataaaaggtgacgttcatccgattctttcacgagggccgcacggaagagcggcgcttcctccagacaaaacggccggacgaatgcgtcagctgactcggcctcatcaagctgaaacggcacgctgtcatggatgcgctgcaccggttcgccgtcaggccccgtttcaaaggacgttctgagcgactcatgccgctcaacaagctgccggaacgtctcctccagccggccgcggtcaagcgggcccgtcagttccagcacagccggcatattgtagccgacaccgccgtcttcaagctgttggagcacatacatccgtttctgcgccgaagacaccgggtaggtgtcctgttttttcgcaggctgaatcgcttcatacgagctttcttccaagtcctgaataaccgaagcaagctcttccaccgtcggccgggcgaagatgtcctgtaacggcacctgaacaccgaactctttggcgatgcgggagacgagagccgtcgcttttaacgaatggcctccccgctcaaaaaagtgatcccggatgccgacggggccgtttttcagcacctcttcccaaagggcgcaaagcttcatttccgtgacgttccgcggggcggtgtacgcctgtctgtctgccgctccgccgggagccggcagcgcgcggcggtcaagctttccgctcggcgtgaccggccactcggtcatctctataaactgagccggcatcatgtaggccggaaggcgtgttgcaagctccgcccgcacgtcatcgctttttcgtccttcaatataggcgtaaagtgcggtttcgccgtgttcggtccgggcggtgactgccgcctcacgaatgccgtcaatgcgccggatcgccgcttcgatttctcccggttcaatccggtagccgcggactttcacttgtccgtctgaacgcccgagccattcaacaaggccgtcttctgtccagcgtgcgatatcgcccgtctgatacatgcgttctcccgggtaaaacggatcatcgagaaagcgctcctccgtcagctcaggccggttcagatagccgcgggccacccctgtccccgcgatatacagctctccgatacagcccggcggcagaagctgtctcttttgatttaaaatatacagccgcatgttatgtccggaaatgccgatcggaacattgtgaaattcctttccttgcggcaaatcaaagtacgccgcttctaccgtcgcttccgtcggaccgtaggaatttgtcaattccgttcccggcagaaggtcataaaaacgggaaaccaagtgagggcccaattgttcgccgccggcaaaaaccctttttaagcaggtctttttgatcggctgttttctggaatttatatattccaagaaagcatgaagcatggatggcacaaaatgagctgccgttatgcggtttttctccaatgcgttcagtatcatttcagggtctttctcgccgccttgcggaaggagaaaaacagaagctcccgcgatcggccaccaaaacagctcccaaatcgaagcatcgaaagagtatgatgttttatgcaaaatggtgtcggaatcctttaatccataacgcgtttgcagcgagtataaaaagtttacggctgactgatgttcaacctgcacgccttttgggcgtcccgtagaaccggatgtatagatgatataagccaatgaatcaggtttcaccggaacattggggttggccgcagcttccgggtttcctgtttgcccgcttttcagagagatcgtttctccctcaaaaagatctggtgcgaaaagttctggttctgccagtaagaatttcacgccgctgtctttcagtaaaaagcgaatccgctcttccggataatccggatcaatcggcagatatgcaccgcctgcttttaagacagcgtaaatgccgatcagcatgtcaggagaacgccggcccataatggcagttttatcctccagccttattccccgcttgatcagccggtgcgcaagctcattcgctctttcgttcagctcctgatacgtaatcgaaatgtcatcagttaaaatcgccggacggtccggcgttttttccgcctgttgttccagcagctcatgaagagactgatgaagcggaaacgctgttttctgcaaggggctgaaagcgtgaagcagagatacttcttctttttctgacaaaacagaaatatcgtctaattccaaacccggatcagctgcggctttttcggcaagtgtcgtgaaaaattccgcccattttcgaatcgtttttctctcaaacaaatcggtgctgtattcaaactggcagtacaattcaccggcgttttcggagatgtacagcgataagtcaaatttagaaatcggcaggctgacgtctgccggctgcagttcaagtccggctgcccttagcttctgctgttccatattttgcagcgcaaatgttgtgtcaaacagcggatttcgggacatgtcccgcggcacaccgagcttatcgacgagctcttctaacgggtaatcctgatgttcgtaagcctcaagcgctgtttggcgaatttcctttaaatattctttgaacgtcatgcttccgtcgggacgcgtcctgaaagcgagcgtattgacaaacatgcccagaacggcgtcaaggtcggcatgaggccttcctgcaatcggagacccgacaatcatatcttcctgtccgcttaaacgggctaacagaaccgtgtacacaccgagcagcgtcatataaagtgtgcatttgttttctttcgccagctttttcaactgtgctgtatgtttttcgctgatgacaaatgacacccggtcaccggaaaagctccgcaccgggggacgcggcttatcagccggcaattcaagcacgggaatctccccggcaagccggttcagccagtactcttcttgtttccgatatgcggcgcccgccataaatgattgctgccagacggcataatctttgtattgaatccgtaacggcggcagacttctctcagcatacagctcactgaattcacgtatcaaaagattgacggatacgccgtctgaaataatatgatgcatgtcagctaaaagcagatgccggtctttttctatttggacaaatcccgcccggaaaagaggcgctttgccgagatcgaacggccggataaacgcttcggctgattgttcttttgtaaatgcaaacggcacttcgtcatgaatcctctgcacaggccggccgtttatttcttcaaaggacgttctgagcggttcatgccgccggatcagctccttgaacacggcttccatcctgtctcggtcaaacggccccttcacctctaaaacggctggaatgttatagctgacaccgccattttcaagctggtgaaggacatacatccgtttttgagcggatgagacaggataggtttcttttgcttctgttttttctatggatgcgaacggattctcttctgcttcaccgatgattttggcgagttcttctacagtcggatagctgaagacatcactcagcgggatttgcacgctgcactctttagctatttttgcaacgagtgccgtcgcctttaatgaatggccgccaagctcgaaaaagtgatcgtgaacgccgatcgggccggtttgaagctcttcttcccatatgcgggtaagcttcagttcggtcacattccggggagctgtatatcgacggcccgctgcgtacgccgaagcttccggaagggcccgctgatcgactttgccgttcgcagtgagcggaatcgcgtcaacgaaagcccatttgaccggaatcatataatcaggcagctctttggccaaatcacttcgcagctgagaaggatcagtcgcttgtgagacggtgcagtaggcgcataattcattttcgcccgactcattcgtttgaatcagcacggcagcttctttcacggcatgatgatttgccagaacggtttcaatttctttcggttcaatccggtaccctctgatcttcacttgatcatctgtccggccgatgtattccatttggccgtccgcacgcagtcttgccaaatctccggtccggtacatgacggcgccctttctgaacggatccggcaaaaatttctcttccgtcagcgccggattgttcacatagcctcttcctgtattcgctccggaaatatacaattctcccgcaattccgagaggctgaagctgtctgtttttgctgagaatatacatcttattatgatggatcggtttcccgatcggcggatgttcaggtatgtcatctcccgcagaaatcgtatacgttgaaaccacatgggtttctgacgggccgtaatgattatgcaaatgcataccgtgtaaacggagcgtctgcctgaacaaacgtgagatagtcagctgctccccggccgtaatgacatgcttcacacagcggggaaaagactgtgcataaccttcttcattgaaaagcatcttgacaaacgcagtcgggaaaaacaccacttccgttttgtgctgatcgataaacgaatacagctgagaaacatcccgtttgattgattcgggcacgatacaaagggtgccgccgcttaagagtactgaaaataactcctgatagcagacgtcaaacgccaaagatgcgtactgcagcacatttgtgcaaaaatcaatgtctgtgttcgtcaattggtcagaaagaaggttggccatatttttatgttcgagcagcacgcccttcggtttccctgtcgtaccggatgtataaatcatataaaggaggtcgtccgccgtattaatggattgcacattgcttccgtccgcttccgtcccggcctcttctatatatgtaacctgcagcgtttgttccgcggggagtgactgatgccgctctgttacaacatggatgcagccgctgttttcaataacatatcggatacgctcctttggactgccgggatctatcgggacaaaggcgccgcctgcttttaaaataccgagaacggccgccgctaaagaaggggaacggccgagcatgatgcctaccggctcctcccgctttaatccgcgtttttgcagcagacgggccagcttattagccgattcattcagctctttgtacgtcactgacccgtcttcataccggatcgcgatttgatccggcgtttgtgcggcctgccgttcaaacatcgcatgaatcgtgtcatactcaggcttttcagtttcttcagaaatcggagcaagcagctgctctttttcctcaggagtgatgattacaagcttatccggcgtgatatcaggtttgtcgagaatctgggaaacgatatgtgtcaaatgacctttgatattttcgataaattggcggtcatacacgcttgaatcgtatctcattttcaaatgaatctcgtcacccggcgccaccataagataaaaactgtaattggtttcgtcttccatgctgaaatcatggatgtgaaaaaggtctttcgtttccccgttgctgttcagcacatcgagctcctgttcaaccggataattctcaaagacgagaatatggtcaattaagccttgttttacctgtgaattcgcctgtatatcataaagcggatgatagctgtatgcctgtcctttcaaagcgtccttttgcacgtttttgatcagcttttgaaacgggatgtccgccccgctgatccggacaggcacggtattaatgaacaggccgatcattcgctcgatgccttcgatttcagacggccttccggaaataacagaaccaaaaaccgcatcttctgtctggttatacgcctgaagcaaaatgccccagagcgtgtggaaaatggtgctcagcgtgacctcttctttcacggccagatctttcagcttagccgtgtcctcttttgaaaaggaaaacgtcacttcttcttgtctgctttcgccggcttttttctgcttcggcagaacagtctgctgctcaaagccttcaaggtatcgttcccagtacgaagcggctttttctttatcttgctccatcagccacttgatgtaggtcccgtacggcacagcgggctcaagcgttaacggtgtccggcgaagccgcgaggcatatatctggaagaactctttcagcacgatcccgagacaccagccatccataataatgtgatgaaaactccaaatgcacgtatattcacattctccggtttgaagcagcatcacccgcatcagcatgtctttttgcaggtgaaatcctttctttcggtctcttcgtttggcttcttcaatatgcttgatttgatcagccttgtttaaattggtgagattttcctcaatgatgctgacgttccgctcttttaatacgacctgctgcggcactgacacgttctggctgataaagatcgttctgaaaatatcatgtctttcgaaaagggcatgaacgctctcttcaaacacgcgggtgtcaaccttccctgttattgaaaaagaggcctgttcggcgtaagcctgtgattccttttgcaggagggaatgaaaaagcattccttcctgcatataagacagcggataaatatcctgaattgcattcttttttgtcatgttataatctccccgtcgcctttttctacagttcctcgacaaaactcgctatgctgtccaaatcatcagatgttaacgttttgctgctaaaatcactaacggttttttctgcttcctctttgccggtgcagtgcgccataatatcacgcaaatattgctgtaaagtttgcagcagctgttccatcgtttctttgcggaagcggctcggcggatagctcaaactgaagtgcagtttatgttgtgctgccatcgcgctcatttccaccgcttgttcccgctgccatgtcggcgtgatgtcgtgcccgctcgcaagaccggataaactgaatgtgtgctgatcttctgtatcattgaattgccctaaatagttaaagctgatttcaggcgcttgtctgaagcggattgttttttgttcagacggtgtcatgtattttaaaatgccgtagcctattcctttatccggtattcttccgagtgtgtctttgaccgtttttacagccgttccaagctcagcgcctgctgtgttcaagtcaatgagcaccgggtacatggaggtaaaccagcctacggtgcggctgatgtcgagctccggcatgatgtgctctctcccgtgcccttccatcgcgatgcgcagtctgccgccccctgtccagtcccgtaaagccaaagctgcggcagtcagaagaatatcttgcgtatcggtatggtaggcccggttgacctgctgaagcaaaacggacgtttcttcttctgtaagcgtaaagcttaccgtttgccgaacgctgtcggctcccgtctgatgctgcggtttttcataaggaagttcggcggctgtttcttcttcaataaaacgccaatattcttcttcacgcatcagcttgctgctttttgcgtattctgaaagccttacggcgtattgcttaaacgaatcggtctttggcggaagctggaccggctgaccttttacggcttgagtgtaagcggcagataaatcctccagcagaatacgccatgacactccgtcaaccgccaggtgatgtacggtgatgaataaataatcccctgaccgggttttgaaccatccggcttttaataacggccctttttcaatatccatccgctgttggagcgcagccacttcatcttctatttctctttcccaagtatctgtctcagacagatcccaaatgtccaagctgtacagttcttctttttgaataccgtgattgatttgtctgatactttcgttttctgcactgacggtgatccggagtgcatcatgatgaatgacaagatgctccaaagcttgtttgagcggctgtttatgcaatgcgtcagagctgaacatcatgacggactgattgaaatgatttctgttttccatccgctgtgataaaaaccagtgctgaacgggtgtccaaggtatgtctccttccaccggccgctgatcgatgactctttccgctttccggataagaggcgcgagttccttaatggacggatgccggaataagtcacttgccgtcattttccacccgtagcgtccgagccgtgcggcaacttgcagcgctttgattgaatcgccgcccaactcaaaaaatgagtcttcaatcccgacttgttttgtgccgagcacttcctgccagatcacggaaagctgttcttcaagctcattgcggggagctgtgtatgcggtttgaagcgcgagctccggttcgggcagatttttccgatccaatttaccgttcggcgtaagcggcagcttctcaagttccatcatataggccggaaccatgtaattcggcagttgcttagaaagtgaagaacgcactttttctgtatccatgtccgcctgcagactcatatatgcgatcagttctttattgccggactgcccggttctgactgacacggcagcttctttcacgccgtccaggctccttagtgcggcttcaatctctcccagctcgacccgataaccgcggattttcacttgatcatccatccgtccggcatattcaatcgttccgtccggcagccagcgggctaaatccccggtgcggtacatccgttctccgggaacaaaaggattagggacaaatttttcttccgtcagctcagggcggccgaaatatcctcttgccacaccgtctccgcctgtgcataattcaccgatgacgccgatcggctgcggtgttcccctgctgtttatgatatatgcggttgaatttccgacagggcggccgatcgggattgaatgatcgtatgattgttcaatcaaaaagcaagtcgagaacgtcgtgttttcagtcggcccgtatccattccataccgagagatacggcagcgcattccgaacccggtttacatgacttggggacagtgcttccccgccgataatcaatcgggataatccggaaaacacgtattcattttgttctgatagatgattgaacaaagacgatgtcagccacagtgtcgtaatgccgttttgctgtataaatgtttccagaacatcagagtcgagataggtttcctggtcacttacatataaagaagcgccgtttaaaagcggaccgaatatttcaaatgtcgttacatcaaatcctaatgatgaagtaaacaacagtctgtcttccggcgtaaaatcaatataattgctgtttttcacaaggcggatcacgcttcgctgttcaatcatgacgccttttggcgcacctgttgacccggacgtataaatcatgtaggccaacgattcaggtccgccgagcggttcgggattttccgaactcaagccggcctttgtttgaatatcctctatgaataaacgttttcctgaaagcggcagaccgtcaagtttatcagattggagaagaatatcagctttacagtctttaagcatccattcagcccgttcccgaggcacatcgtcaccgataggcaagtaggcgcctcccgcttttaatattccgaggattccggaagcaagctctattgtgcgtccggttaataaggcgacaacgctttccggaccgacgccatttgatcggagagccgccgctattctgttagcccgttcgttcagctcacggtatgtcaagatttgtccatcatatacaactgcccgggcatcgggggtttcttcagcctgccgctcaaataaacggctgatggtttcgtgtcttgggtaatcgcttttcgtctgattaaactgataaatgacgcgatttgtttcagcatcatccagtacgtgaatgtcaccaagcggtattgtttggtcttcaattacttttgtaagaattcgggtaaagtaagaaagccatttttcgattgtctgtttttgatagatatctgtattgaattcaaaatcaaagctgatggaaccgtcagacccttctgacgcgtaaagcgtggcatcaaactttgcggttttatgacttgtatccgcagcttgagtcaaatgcagctcatttaaattcagggattcacgctccatattttggagcacaaacatcacgtcaaacagcggattgcggcttgtgtcccgctgcacgccgagccgttccaccagctcttcaaacgggtagtcctgatgctcatacgcctcaagcgccgcctggcggacttccgccaagtaatcggtaaaccgtttgtctcctttcggctccgttctgatggcaagcgtgttgacgaacatgccgagaatcggttcaaggtctttgtgcggacgcccggcaatcggcgagccgacgatgatgtcttcctgcccgctcaatctcgcgagtaacgtattgtacgcggcgagaagcaccatatacaaagtggagccgtaatcccgggcgatgcggtgaaggccggatgccgtttcagcgtcaagcgtgcacgatacgctgccgcccgcaaagcttctgacagtcggacggggcttgtcagccggaagctcaagcaccggaagctctccttcgagccgcttcagccaatacgcttcctgcttctgatacccttctttctcctgaaacgaccgctgccagacggcatagtctttatattgaaggcgcatcggcgcaagcgaacggcctgcgtacagctcgccgaattctttaatcaaggtgttgacggacacaccgtcagaaataatatgatgcatatccgttaataaaagatggcgttcgtccgattctttcacgagggccgcacggaagagcggcgcttcctccagacaaaacggccggatgaatgcgtcagctgactcggcctcatcgagctgaaacggcacgctgtcatggatgcgctgcaccggttcgccgtcaggccccgtttcaaaggacgttctgagcgactcgtgccgctccacaagctgccggaacgtctcctccagccggacacggtcaagcgggcccgtcagttccagcacagccggcatattgtagccgacaccgccgtcttcaagctgctggagcacatacatccgtttctgcgccgaagacaccgggtaggtatcttgtgtttgcgcaggctgaatcgcttcatacgggctctcttccaattcctgaataaccgaagcgagctcttccaccgtcggccgggcgaagatgtcctgtaacggcacctgaacaccgaactccttggcgatgcgggatacgagagccgtcgcttttaacgaatggcctccccgctcaaaaaagtgatcccggatgccgacggggccgtttttcagcacctcttcccaaagggtgcaaagcttcatttccgtgacgttccgcggggcggtgtacgcctgtctgtctgccgctccgccgggagccggcagcgcgcggcggtcaagctttccgctcggcgtgaccggccattcgctcatctttatgaactgagccggcatcatgtaggccggaaggcgtgttgcaagctccgcccgcacgtcatcgctttttcgtccttcaatataggcgtaaagtgcggtttcgccgtgttcggtccgggcggtgaccgccgcctcacgaatgccgtcaattcgccggatcgccgcttcgatttctcccggttcaatccggtagccgcggactttcacttgtccgtctgaacgcccgagccattcaacaaggccgtcttctgtccagcgtgcgatatcgcccgtctgatacatgcgttctcccggataaaacggatcatcgagaaagcgctcctccgtcagctcagggcggttcagatagccccggccacgccggtccccgcgatgtacagctctcctgccacgcccgcaggctggacggttcccccgccgtctaacacataaagacgggcacccggaacgggttttccgatcggaagccgcgtccgtccgctgtcccgttttcgatcacagacgtaaaaggccgcatcgaccgtcgcttccgtcggcccgtagccgtgaataagcacggtctccggcagaagatcggcaaaccgggcagccgtaagcggggaaagagcttcccctccggcaaacacgcgtgtcagtgttctgccgaggcgtgttcttgtttctgcaggctcagtttccagcgcgtctaaaaagctgttgaccatcgccggaataaaatgtgcggtcgtcaccttttcagaagaaaaagcttcaatcatccgcactggatctttctcccagccggccggaagcagatacacggaggcgccggatatcgtccaccaaaacaattgccagatggaggcgtcgaatgaaaaggatgatttcagcacgataatatcctcttccgttaacggaaactgcccttgcatccctgataaaaaggcggcggcttgacggtgttcaacagccactcccttcggtgttcccgtcgaaccggacgtataaatgatataagcgagcgaatcagcatccgcttcgtcagagacagcccctgtctccgtctcacttgtcagagcagaaagagacacttctagcgtttcgccggaaaaaccggaaacggataaccccggctgtgcaagcaggagacaagcgccgcagtcatcgagcatatagcgcagcctgtcctcaggatagtcagggtcaagcggcacataggcgccgcccgcttttaacacggcaagcacagaaaccgccatctccggcgagcgttcggcgagtacgccgaccatgctttctttgcggacgcctttttgtcggagccggacggcgagcctgtccgtgtactgatcgagctcggcgtacgtcagcataccgtccggaaaacggagcgccggacgatgcggcgaaagcgcggcgcggcgggcaaacagcccgtgaagcgtcggagccggcggttcaaccgtttctgtatggttaaatgcatccatcatacttctggcttcacacgcatccagcaatgcgatctcggaagcgccgatttcagggtcggaaatgactgagttcaccatatgccgtaaaaatgtttcgatattcttcataaaaacatcgtcgtatataccggtatcaaattttaagcggatataaagagaattgcccggaatcacctttatgctgcatccgtagtttgtgacttcttccatcgtgaaatcctctaccgcaaaatcaaatgaaccggcctgactcacattttcaatttcacgctgggccggcacattttcaaacacgataatatggtcaaacagcgcttgcttcagagggctttgcgcctgaatgtcatacagcggataatagctgtaagcttctgcttgcagcgtctcctgctgcaaatgcctgacaagctccagaaaagaaaatgaaccgcttttcacccgtacgggaatcgtattaataaacagtcccaccattttttccacgcctgcgagatccgacggccggccggaaacgacagaaccgaaaacggcatcatcacagcggctgacacgctgcagcaaaatgccccacagtgcctggaacactgtattcagcgttgctccagcccttgccgcaatgttcttcagctcatttgtctgctcttcagaaatggtgaaaaccgcctgctcaagttcgccgtttggttccgcggattttttcggaagagacgccgattgctcaagatcggcaagtctcgttttccaaaaaatctcagcttctttacgatcctgcttcatgagccatttaatatacttcccatatggctgaacaggctcgagagacggaagccgtccgtctcccagagattgatagatcatcagaaattccttcatgacaattccgaagcaccagccatccatgacaatatgatgatggctccatatacaaacatagcgttcaggcgcttttttcaaaatggagactctcatgagaggatctgattgcaaatcaaagcctttatctttatcttcttttctgaaccggtcggcatatttgtcttgcgccttctcgtccaaatgagaaatatcatgaaactgaacgcggctcggcctgtttttcagcacgacttggcggggctttgccacattcttgtgaataaatgtcgtacggaaaatatcgtatcgttcaaaaacagcatctatacttttttggaatcgttcccggtcaagctgtccgctgatcgtaaacaccgcttgttcgaagtaggctcttgagtcatgatccaacagagaatgaaaaagcatgccctcctgcataaaagccaaaggatatatatcttgtatttccggttgctgccccattgcgccactccttttctatagtttgttgacggctcccataatgtcattcagatcttccagcgttaactcctcgtcactgaaatcagcggcgctccattcacgctcctcttttcctgtgcaatgcgtgatgatctgcttgagaaaggtatgaaaatatcccgtcaaaacttcaatcgtttctttttgatactgaaaacggttgtacacgacatgcatgctgagacattccgacgatacggagccgctgatatcaagtgtgtacgggcgttcccagtctgggctgacttcatttcccgcttttacgggagaaacaccgaagccgctggaacggatttcccggtcaaactgtcccagatagttaaaactgatttcaggagaatcagattcagtctctccccagagtttgcttatatatttcagcaccccgtatcccgctcctttatgcggtatgcggcgcatcatgtcttttgtccgcttaatgtgataaccgagacgctcaccgtcatcaggctgatcttgaaaacttgcgtcaaccaataccggataaattgacgtaaaccagccgatggttctgctgatatcaagatgctccaggtgctcttcccttccgtggccttccatgctgattttgaatgcctcgtttccggtccatctgttcagcgcaaggcttaacgcggcaagcaataattcgcccgtctctgttgtgtatgctctgttcgcttccgttaacagctgctcggtctcctgttttgtcaatgtaacggtcatcacatctgtatctttcagaagattggaagagatacgggcatctttcggaagcggtttgaccgccgctttttctctttcggaccagtagtctgcttcctgtaacagccggcggctttttgcataatcagagatttgctttgcgtaagtctgataggaatcggttttcgccggaagcgcggtttcttttccttcgagcgcctgcctgtagcacgcggtgagatcttcaaataaaatcctccatgacactccgtcaatgacaaggtgatgaatggaaagcagcagatgatcgccatcagcggcatgaaataagccgacagctacgagcggacccgtctccagccgaatggaagtttgaatacgggcggccgcctgttcaattgcggcgtgctcctcttgtaatgaacctttctctcttacgtcatgcgtttcaaacgtaaagagttcttcttcagaaaggttttccgctctgttatattgaatcaccgatccgttttgcgtgccgcataccatccgtaatgcgtcatgatgaaccgcgagctgtgccagcgcttttctcatagcagattcattgattctgtctgcactgcggagcataacggactgattaaaatgatcatgcggcaatgattgcgaaaagaaccagtgctggatcggcgtcagcggcacgtctcccgtgacgggagactgatcaatcacgcggcggactttccggagccgcatcgacacttctcccagtgtctgatgctcgaacagctcgcggacggtcgtttcatagccctgctgtttcagcctcgcacatacttgcagcgctttaatcgaatccccgccgagatggaagaaatgagcattggggccgagtccttcaacacctaagagttcttcccagatgtcagccatcatttcttcagtttcatttctcaggctgatatcatctccaaggctttcatttaattcaggctgcgggagtgccttctcgtccagcttcccattcgccgtcaaaggcagttcatcaagctctatcaagcgggcgggaatcatatattccggcagaaaagctctgagagaggcctgaatctctgcttcttttattttttcgttcccgtgtatgaccgcgtatgcgtaaatggagtgctgaccgtgctgatcagcacgtgtgatcacggcggcctctttcacgaaggaaagctcctgcagcgctgattttatttctcccagctcaattctgtggcctctgacttttacttgcgcatctatccgcccgacatattccagctcgccatttgagagtcttttggcaatatcgcccgttcggtagagccgcatgccggtattgtgcggattcgtgatgaaccgggaggcggttaaatcatccctgtttacatatcccctcgcgacgccttccccgccgatataaagctcacctggaattccgatcggctgcggattcatataggcgtccatgacaaaagcatgaagggtttccagcggtctgccgatattgcttttatttctctcaatatcatccatcttcagttttttgcatgtgacgtgaaccgtggtttccgtaatgccgtacatattaacaagctccgtctccgggtacttctctttccagcttttcagcatgccgggctgaagcgcttctccgccgaaaatgacatatcgaagcttcagcttgtccgcatgcccggcctcttcatgaatgagtccggaaaaagccgtcggcgtttgattcagcaccgttacgccttcactttgcagcagctgccggtacaaatgcggatcacgggctgtttctttcggcacgataactacctttccgccgtataagagcgcgccgaatatttcccagacagaaaaatcaaaacaataggagtggaacagcgtccagacgtctccagagccgaaatcaaacggcagtcctttatgtgtgataaggctgatgacattgcggtgttccgtcataacgcctttcggttttccggttgtgcccgatgtgtaaatcacgtaagccggctgttcaggcgttatcatttctttcgttctgtctgctgaaacggattcaggcttatcaatgtataataccggcagcccgtccattccggatatcccaagacccgattgcgtcaacagaacacgcgcgccgctgtcagtcagcataaatgaaatccgctcgtccggatagtcaggatcaatcggcagataagcccctcccgcttttaaaataccgagaatcccaatcagcatatccggggatcgttcggtcataattccgacaatctgtccggagcggatgccgttttccgacagcatatcagcgattcgatccgccttgtcattgagctcgcggtaggtgagacgctcatcggacataacggctgcaatttgatccggcattttttccgcctgtgcttcaaataaactgacgatcgtctcatgcttcggatactcagctgtttgattttccgcttgaagaagcatctgccgctcgtttgtgtccagcaaatgaatgtcagacagcttctgctcatcatccgatgcgatttgtcctaaaagctctttaaaatgaccggcccaccgttcgatcgtatctttttcaaacaacgcggtactgtattcaaaatgaaaatccagtgagccgtccggctgttcctcggcatgaagcgtcaagtcgaattttgaaatgtcatgtttcactgcatgtgaagaaacggataagcccggaaggttcactttgaaatcatcactgttttgcaaaacgagcatggcatcaaacagcggattgcgattgacttcccggtgtgtatcaagcttttgggcaagttcttcaaacgggaagtcctgatgttcggctgcgccgagggcaagcattttcacctcttctaaataagcgcggaatgtcttatcccctttcggcctgcttctcattgctacggtatttacaaacatgccgatgaccccatcaagctcagcgcggcttctgccggccgcaggtgaaccgacgataatgtcttcctgcccgctcaatttagaaaggaacaaggagtagcctgccaaaagaatcatatacagcgtcgaacccgtctcatccataagccggcgcaaattctccgccgtttctttttgaaggcgcgttcgtacaacggacccgctgaaatcaggaagctgcgggcgctttttatcgagcggcagatcaagaacgggaatgttttccccgatcgcatccagccaataccgctcatgtcttttgaattcttcagcggcgaaccgctcatgctgccagacggaaaaatctttgtactgaagttttaacggccgcagctcttttcctctgtacaaatccgtcaattcttgaatcagaacgctcattgacacaccgtctacgataagatgatgcatatcaagcagcagaaaatgacgttcttcagtggctttggctaaagtcactctcaaaagcggcgcttgttccacgtcaaacggcttgacgaaagtttccattgtcgcttgaagaagtgtcccggatggcatgtgaatctctgtgagatcgagatcgacatgtgaatgtatgtgctgcatcggctccccgtttcgcaaaacaaatgatgtgcgtaacgcttcatgcctttgtaacagcgctgaaaaggcttcgtgcagacgatcacggttgagtctgccgctcagctccagacaagcgggcatatgatagcccgtactgtccgccgcaagctgatgaagggcatagagccttttttgcgcaaaagatagcgggtacaagtcctttgcctccgcaggcatgatttctgcatattctcctcttttcctctgttctaggaagcgggccatgctctcgatagtcggatgttcaaaaacatggcggacggcaagttcaatttgcagccgtttatgtatctttgaaacaagcgacgcggctttcagcgactgtccgccgatttggaagaaatcatctctcatactgatgtgttcccgtttcagcacttcttgccaaatagacagcagctcagtctcaagcattgtgcgcggagcttgataatcaccggttctctcggcttctttcggctcaggaagtgcggcccggtcaagttttccgctcacagacagcggcatttccgtcaatttggtaaagcttcccgggatcatataagcaggtaatctcccggccaattcggcatgaggatcaaatgtcacaccgacgttttccagtacgacataagctgcaagctcctgttccccgtccgccgttttgcgcacggtgactgccgcctcttttaccccggacagacttctgagtgccgtttcgatttctcctaattcaattctgtaacctcttaccttcacctgatcgtcaaagcgtcccatgtattcaatcgttccgtccggtaaaaatcgggctgcatctcccgttctgtacaaccgttcacctttacgaaacggatgaggggtaaagactttgtccgtcagctctttttgctgaaaatatccgtccgccagaccttttccggaaatacacagttcaccgacggctccgaccggctgcagccgatctccgtgcatcatatagacagaagtgttggcaatcgggcgcccgatcgtaatccggctgcttttttgcaggttgcgcagaatcgtcgtggccacactgttttccgtcggtccgtattcattcagcagctcggcattcgggcatatgttgcggctcgcttccacgatatcaggggtggccgcttccccggcaaatgtcaccgcccgaagcgtctgcgcatcctttttcgtcagcgaatcaagcagaacgcgatacagagacggaacgatcagaagatggctcactccgtggcgggcgattttctgttttattgaaaggacgtctttcgcatcatcttcatcagttaacagtacacaggcgcccgacagaagcggagtgaaaagactcgttaatgacccgtcaaatacgtatgaaaaaagatgaagcgctatgtctccttctgtcatcccgtattcttcacgccgccattgcaatgtattgctgatcgctttgtgttgtacaagcacccctttcggccggcctgtcgttccggaagtgtaaatgacatacgcccaatttccgctgtcagacaccggcggaagcggtgcggtctgctgggaaaccgtttcctccatgatgacgacgctgcccttgaaatgcggcggaatgagggggagcaggtctttttcagtcaggagcagtgaggcttcactgtctctcagtaaaaatgaaatccgttcaggcggaaattccgcatcaatcggcatataggcgctgcccgacttccaaattccgagcagagcggcaaccgtactcattgatcggcgcagcataacagcggtgatctgatcggaacgggcgcctttttcccttaacgcatgggcaatctgattcgcccgctgatttaattttttgtagctccagcttactccgttatatctcaacgcctcttggtcaggcgttattgccgcctgttcttcaaacagcccatgaacggttgtctcagggtacggacggttcgtttcgttaaacgaatgaatcagggcttcttcctccggaggtacgagactgatgcttgataaaagcctgtccggatcttccgttacacaggagatgacctccagaatatgccctttgatccgtttcatgtcttcccgatcgtagatgcccgcattgtagctgaatttcacataaaactcttctcccggaacgatgacgacgttaagatcgtaattggtttcttccgccatcgaaaagttttcaagtgagagcgcactgctttccgtttgctgccagccgtttaccgcagcctgcatctgaaccggataattttcaaagaccaggatatggttcaagagatctttttgcagaccgctctcgttttggatgtcataaagcggataatagctgtgctcttccgcagcgagtgactctttttgcacctttttgagaagagaagaaaaagtcatatcaccagccgcgcgcacccttaccggcacggtattgataaacagtccggccatggattcaatgccgctgatagctgacggcctgccggaaacaactgaaccgaagacggcatcttcagtcccgttgtaacgatggagaagcagaccccaaatgcccgtaaatatagtattcagcgtgaccccgatgcctcgggcaatgtctgtcagtttttgcacggtttcaggctcaagggaaaattgaaaatgctcagatgcataacagtttttcgccggcttattcttcgtttgcggaacggaaacggtttctccgtaatcttccaagcagcgcgaccagaacgctgacgtctcttctttattccggcttcggagccatttgatataagtgctgtaaggagccggactgccgaggtttacagacctgttgtttcggatcgcataatacatgctgaagaaatctttcagtacaaggcccaagctccagccgtccatcataatgtgatgatgagtccaaacgcatgtatggcggttttctcccgtttgaaaaagagtcaagcgcattaaggggcctttttgcagatcaaaccccttatgccggtcgttttccttaaattcgtcaatgatgctttgctgccgttcttccgaatagtctgaaatgttctcagtctgtacggcagtgtcacggagtgaaaggacaacctgctgcggcccttcaaggtcaggcacttcttttatgaaaatcgttctgaaaatatcataacggctgacaagcatatccagacttttttggaatgtatcaatgcataaatccccgctgactgtaaacgaaatctgctcgacatatgcgtttgatccggaatccagaagcgaatgaaacagcatgccttcctgcatatatgataaagggtaaatatcttgaatttctgtcgcttgtgtcacgaatgccacacacctttttatgaaattaaagtccttttacgagatcttcaatgcttgatagtgcttgagcggtcaattctgtatggctgtaatccgttaatgttttttcccgctctttcttgccggaacaatgggcgatgatgtcctcgaggtgagtatggaaacgattcatgaagaactcgattgcccccggtgcaaatacatcggtataaacggcttttacctccagttgcccggccgccaccatcgcgttaatatccagatcaaactcgcggatgcgcccggatgctatatcatgctgcggcttgaacggtgacatcttcagcgtcccctcaagaccgtcaaacgcaccgagatagttaaagcttatttctgggtctttataaagaatgtttcgcgaatatctcagcagcccgtagccggttccgtgatgaggaacccgtctcatcatgtcttttaccgtctttatgcggtgcgcggttttttcgcctgagccgtccggcactctcatatccaaaagcaccgggtaaacagatgtaaaccagcctgccgttcttgacatatcaatgtcaggaatatgcccttggcgtccgtgtccttcagtgctgataagcatctgttcggaacccgtccactcatgaagcgccattccaagcgccgttaaaagcaattcatgaacatccgttccgtatgcctgctgtgtttccaacagcagctgcttcgtgacttcgctgcttaatatccacgatgcagtgtgcgcgttttcctgcaatcgtccggcgttttcatcagttattttcggcagcggcgctgttttaccagacatcacgctgtcccagtatgcggcttcctccagcaatgctttgctcttggaaatgtcaaaaagctcttcagcatactttatataagaatcgcttttcggcggcagttcgatttgtttgccgtccaatgcctgctgataagctgtctgcagatcttcaagcaatatcctccatgacacgccgtccgtgataaggtgatgaatcgtgataagcagatggtcggcttctttcagcctgaacactccgagatgaagaagagggccttgatcaaggcgcatagcctgctgtatttctttttcctcagcggctatccgtttttccggctgtgtttcttctgaaagatctatgacgttaagcgtaaagatttcttcatgctgctctgtgattccgcggttatattgaacaacttccccatgctcattttcagtgaaagtcattcgcagcgcatcatgatgttctgtcagcgcgcaaaccgcctgatacagcgcatctatttcgaggctgtctttactgcacagcatgactgattggttataatgaagctcaaacgcacccggctcctcaaaaaatctctgctggatcggtgtcagcggagcgcttccttctatcgggccctgatcagccgttgcaacagccggcgtgaggtgtttcgcgagttctgcaatcgtcgggaactgaaacaaatcgcggatcgacatgttccagccttctccggcgagtcgggctgacacttgaagcgccttaatggaatctcccccaagctcaaagaaagagtgatgaattcccgctttctgaatatgaagcacatcttcccaaatccggcataacatcgcctgtttttcatcgccgggcgcgacaaatgcctgtgatgaatgtatctcttctgccggcaatgccgatttatcaagtttgccgttcagtgtcaggggcatgctgtctaaaccgataatatgagacggcatcatataagccgggagctcctgcataagagactggcggagtgatgagatatcggcctctttaggaacgatgtatgccgctaaccgggcttgtccttcggcatctttcatcacggtaacagccgcttctttgacttgatcgtgtttcaaaagcacactttctatttctcccgtctcaattctgtatcccctgatcttcacctgcttatcaatccgcccttgaaaacgaagagttccatccggcagccagcaagcctgatctccggttctgtaaagcgtttctcccgtttgtaacgggtcactgaatgcgtcctctgtcagctcaggctgtccccaatatcctttggcgacgccggcgcccccgatatacagctctccgaaaacgccgatcggctggacctgtttgtctttgtttaagatgtacatttgcacattcggaagcggaacaccgatcggcacatcatcttcccgcggctcttcgctcattccggcttcataatacgaagagtcaattgtcgcttctgttacaccgtagctgttaatgatccgcatttctttcccaaagcgttcatgaagcgtataaaaatcttgcgacttgatcatatctgaaccaagtaccagtatttttacgctttgcagcgcgagtttccggcggtatatatattccataaacggaacaatcagcgcgggtgtcgactccataaacgtgatacggtgctgatcaatgagccgataaagctgctgcggctcaagccggacgtcatccggacaaatgacaagcgttcccccgtttagcagggcgcgtgcaagatcccctgaaaatacatcaaatgagaaactcgccatctgcagcactctgaccggtataagatcaagctcataaatcctgcgccatgcaagtgctgcatgcgtaaagctgcgatttctgacttcgactcccttcggcgttcccgttgttcccgaagtatatatgatatatgcggtatcatccggtgacgctgccggctgaatattctttgcagaaatatcgtattgatcttcataatcaagctgaatgagaaataaattgtgatccgtcagctgtgaagcaagttctttgtattctgactgcaccatcaagacggatgccgcgctgtcttttaataaatagcgaatccgttcctcaggataatgggagtcaaccggtatatacgcccctcccgatttcatgacggcaagaacactgacgatcgcttcaatcgaacggtttgctaatatggctgctctttttcccggaccgaatccatttttctgcagtgttcgggcaagacggtttgcccgctcattgagctgcaaatagctgatctgttgtgctccttcaataacagcggtctgatgaggcgtttcttctgctttctcttcaaacagctggtgaaacagtttgtgtttttccatgaattcggtttgtgtgttattaaactcaatcagtaacttttgtttttcttcttcatccaaaatgtcagctttcgatagtgtgacttccggttcggcggcaacatggcgcaagagattcagtaagtggcccatccagcgttcaatcgtttctttcataaaaagctcggtgctgaattccatctcaaagcggatgtttccgtcggattcagccgctgataaggtcaggtcaaaacttgatacatcatgttcggtatgctctgatcgtgacgccttcagaccggccagatttatctcctctcgctccatattctgaagaataaacatcgcgtcaaacagcggattgcggctcatgtcccgctgcacgccgagccgttccaccagctcttcaaacgggtagtcctgatgctcatacgcctcaagcgccgcctggcggacttccgccaaataatcggtaaaccgtttgtcccccttcggctccgttctgatggcgagcgtgttgacgaacatgccgagaatcggttcaaggtctttgtgcggacgcccggcaatcggcgagccgacaatgatgtcttcctgcccgctcaatctcgcgagtaacgtattgtacgcggcgagaagcaccatatacaaagtggagccgtgatcccgggcgatgcggtgaaggccgaatgccgtttcagcgtcaagcgtgcacgatacgctgccgcccgcaaagcttctgacagccggacggggcttgtcagccggaagctccagcaccggaagctctccttctagccgcttcagccaatacgcttcctgcttctgatacccttctttctcctgaaacgaccgctgccagacggcatagtctttatattgaaggcgcatcggcgcaagcgaacggcctgcgtacagctcgccgaattcttttatcaaggtgttgacggacacaccgtcagaaataatatgatgcatatccgttaataaaagatggcgttcgtccgattctttcacgagggccgcacggaagagcggcgcttcctccagacaaaacggccggacgaatgcgtcagctgactcggcctcatcgagctgaaacggtacactgtcatggatgcgctgcaccggttcgccgtcaggccccgtttcaaaggacgttctaagcgattcatgccgctccacaagctgccggaacgtctcctccagccggctgcggtcaagcgggcccgtcagttccagcacagccggcatattgtagccgacaccgccgtcttcaagctgctggagcacatacatccgtttctgcgccgaagacaccgggtaggtatcttgtgtttgcgcaggctgaatcgcttcatacgggctctcttccaagtcctgaataaccgaagcgagctcttccaccgtcggccgggcgaagatgtcctgtaacggcacctgaacaccgaactccttggcgatgcgggagacgagagccgtcgcttttaacgaatggccgccccgctcaaaaaagtgatcccggatgccgacgggtccgtttttcagcacctcttcccaaagggcgcaaagcttcatttccgtgacgttccgcggggcggtgtacgcctgtctgtctgccgatccgccgggagccggcagcgcgcggcggtcaagctttccgctcggcgtgaccggccattcgctcatctctataaactgagccggcatcatgtaggccggaaggcgtgttgcaagctccgcccgcacgtcatcgctttttcgtccttcaatataggcgtaaagtgcggtttcgccgtgttcggtccgggcggtgactgccgcctcacgaatgccgtcaattcgccggatcgccgcttcgatttctcccggttcaatccggtagccgcggactttcacttgtccgtctgaacgcccgagccattcaacaaggccgtcttctgtccagcgtgcgatatcgcccgtctgatacatgcgttctcccggataaaacggatcatcgagaaagcgctcctccgtcagctcagggcggttcagatagccccgggccacccctgtccccgcgatgtacagctctcctgccacgcccgcaggctggatggttcctccgctatctaatacatacagacgggcacccggaacgggttttccgatcggaagccttgtccgtccgctgtcccgttttcggtcacagacgtaaaacgccgcatcaaccgtcgcttccgtcggtccatagccgtgaatgagcacggtctccggcagaagatcggtaaaccgggcagccgtaagcggggaaagagcttcccctccggcaaacacgcgtgtcagtgttctgccgaggcgtgttcttgtttctgcaggctctgtttccagcgcgtctaaaaagctgttgaccatcgccggaataaaatgcgcggtcgtcaccttttctgaggcaaacacttcaatcatccgcacaggatctttctcccagccggcaggaagcagatacacggaggcgcctgacatcgtccaccaaaacaattgccagatggaggcatcgaatgaaaaggatgatttcagcacgataatgtcctcttccgttaacggaaactgcccttgcatccctgataaaaaggcggcggcctgacggtgttcaacagccactcccttcggtgttcccgtcgaacctgacgtataaatgatataagcgagcgaatcagcatccgcttcttcagagacagcccctgtctccgcctcacttgtcagagaagaaagagacgcttctagcgtttcaccggaaaaaccggaaacggataacccccgctgtgcaagcaggagacaagcgccgcagtcatcgagcatatagcgcagcctgtcctcaggatactccgggtcaagcggcacgtaggcgccgcccgcttttaacacggcaagcactgaaatcaccatctctggcgagcgttcagcgagcacaccgaccacgctttctttgcggacgcctttttggcggagccgaacagcgagtctgtctgtgtaccggtcaagctcggcgtacgtcagcataccgtcgggaaaacgaagcgccggacaatgcggcgaaagcgcggcgcggcgggtgaacagcccgtgaagcgtcggggccggcggttcagccgtttctgtacggttaaacgcagttaacacccgtttcttttctttttcatccgccatatcaatatgccgaatcagccggtttggatttctaacggcattttcaacgatcgtcagcaaatgagtttgaatccgtttaatcgatgtttcagtaaataaagcggattgataatcaaaattcagctcaatcaaccccgtatctgtccgctccttaattaaaatggacagctcatttgccgtatgcccgctgaaaaacatcgccgtttcataatcgaagccctccgcctgatgccacgcgagaggctggtattgcatcgaaatcccgatgatattttgcagatcgtgatgaacctgccttaattcattgacaaaaagattgtaaggatatttctggtgccgcataacagacagctgctcttttcctacgctgcggacaaaggacaggaactccgcatcaggatctgccgtcattctgatcggcagtgtgctgacgaacatgccgagcatatccttttcgagcctggagccccggtttccgtaataagtgccgatggcaatatcttttttagccgtcagacggctgatgcatatgtataacgaagccataaacagagagatgatgctgatattattttctttgcaaaaacgccggatagattgttctaaggagtgagaaagagtgattgtatctctggaagccgcagtgctttgtctaagatgagaggttcgttccgccagtgaaaggtgttccggaacggttcggtatgtttcagtccaaaatgaacggtccttttgaaaacgggaagactgtaagtattgctgttctttttccatgtagctgagataggaaggcctgtgatgttcagctaaatcctcgccccgcatgatcttttggtagatatcaatgagctggttgccgagcaggttgagcgagatgccgtccatgataatatggtgaaattttgaataaagccaaacttcttcgtctgacatgacaagcagagtaaattgatacagaggtgaatgaaacagcttgaacggaacacgggtctgcgtgtcaatccatgcgtcccgctctgagttatcagtatgagtaaaatcaacagtctctagagaaatcggccgatgcccggccagatacagctggggttctgatccgtccccttctgtcagttgaaacctgagcgaatcattttgcgagatagaaaaatctaaagcatggcgcagtacgtcaaaatcaatgtcccccctgaatttgacgcatgccgcgagattgcagatacttgtgcccggttcgagcagctcggtaaaccacactcttctttgtgcgtgagttaaagaataaacagtgttcttcaatggaatccctccgcttcaatttaagaggataagaaagtgaaataattacaattaaatttcgacagcatatgactaaatcatccatataagcattattttaaaacatattttagaaatcacaataaaaaattaaattttctctaacattttttagaatatagtatatattcctcacttcatttcttcatttctataatctttataccatgtaaaacggtatgtatgcacactgaaaactagttcttaaacactataataaggaataaaatgtataattaattgcgattttaaaaaggttttgcctcctgaaaagaagtttcatgttagaaaatgaaaaatcggtgaacaagtaagaaagtagtatgtaaaaaaaaggaagtatattacgatattactttttgaaaagattgattcgtaatcgcaatataatgttttacagacatcaaaaaaagccgaaccctctaaggatccggcccttcttattgatttgccagcacgactgcgattttgtcttcaatgtcttttccgtcatcttcgtcaagcagcccgttttgaagcacggaaaaaataagcgtatctcctgtttttgtgtctgcatagccggcaatcgaactgactgatgttagtgacccggttttcgctttaattttgccctctgccggagtattcttcagccggttccgaagagtgcctcccgtcattctgtcgcttgcaccggcgacagggagcgaacgaaggaaagccgggtaccacttttctttctgaaccgcatacaaaagctctccgatttggccggcggatacgccgttaatatgagaaacgccggatccgtctcttgcaatcaattcatccggattcagcccgaacgatttgagctccgatttcatcacgtccaagcccttttcccagctgccctccccttttttcacttttcccatttccttgatcagaatttcggcgtgcccgttgttgctcagtttcataaacgggatcaataattctgaaagaggcatggatgtccgtgatgtgacaagctgggtgcggtgcggcattcgccctgttctgattttcccttttacagttataccctgtttagtaagcgcttgtttccataaatctaaagcataggacgacgggtcccacactgccgcccattctcttgcctttgccgagccggcaggtatggttccctttatcgtaatcacattgccaccgtgctcccgttcaaccgtcaattctttcttttcatcagaagcgacggttttcacttcatttttcacacgaacgacgtccgtatggggagaaatcgaaatacgcggctttttaccgggctgtttcgccggggtgatttcagcaatcaccgttccggtatcataatcttcatttggggaagcagtaagagctgatacttgcgcgccataatattggccttcatcactccacggaagatcaactgaatacctggtatcgtcataccacgaatcatccccgaccagatctcctttaatgacatggatgcctctggctttgacctgtttagccatcttctcaaaatcagaagccattagggtcggatcgccttttcccctgagataaaggtttccgcgcagctgttttcctttcacggcgccgtctgcccgtacttctgtcttaaaggtgtaatcttctccgagaacggaaagcgccgcagatgccgtcagcagtttcatcaatgatgcaggcctcagccgcatatcttcccggctgccgaacagcacctcccctgtttttgctgaccggacactgacgcccgctgaagccccctttaaagcgggttcttcatccagaatgtgttccagctctttttgcaaagtatttttttgttcagccgccttagccgcatcatcaatataaggaacttcggcaatgatcaaaagcagaatcaccgcgcacaagcgtttcacatatgttttcaatgttatcccgcctctttcctattcttcgtcatgcaaaatggtgatcctggatgacgcagccgcttcttcgcccggtttcagaatctgaagccctgtcagtgatgcaggctgattcagattaaaagcatctgtaacggaagtataaggctcaagactgacaaacccctgctttccgtcgccgttatataccacccaatgcttgaaagacgtgtccgcttgatacaaaacggataatttctcattcggatgataaataacagcttcgttattgccgccattccgtccggaagaaagaaaaacatcgtcaaactgtttatttttcaaagacatcccgtgacggaacgcttctttatcaggcacatccaataaacggcctgtcggtacgaaacgttcatttaattcccacatgcggtcagccgtcaaaaatagacgggatcgctcttcattgaaaacaaatgtggaatgatagcctagcccccaaggaaaagcctccgttcccttattcataatcagcgcccgctgcgtaaacacattgtcttttaatgtataggtcatccggacaatgacatcgtgcggaaattgtttatgaacacggggaatctttgaaagatcaatttctgtttcgactgtcattccatcgccctcttctttcgctgccgccgctttccaatgctgattgtgaagaaagccgtgaatatgattatgtttatcctcttcgtttatctcgaattgatacgcgcgcccgtcaaaacgaaacgtcccgtccgtaatccggttcggcgggaataaaacgggaatgccgtacagcatcggttttttgaggaattcctccgcagtttccggttctctcagaagccgcataccggttcttttatcccgaagcgatatgacatttgatccccactccggcacaatgatgcattcagcctgatcagtctccgcctttatggctgaaactcctaaataagtcgtatgttcaatcgtcataagcacctgccctttccttgttttctagcatgtataggaattccattttctaaactcattttccttctctaaaaaaaacatcgcccgtatgaattgagcgatgtgcggtaaaaccttattgaatcagccgggtaatctgttttttcttccatacaaaccggtaatatccgtattgcagcagcaggctgacgacaaaagccgccggataaccgacccaaatgccgagaatgccgagattcgtataatgagaaagaataaaggccacaggcacttcaattccccaaatcgcaaaaatgctgataatcgtcggccataacaccgtaccgctcgcccgcattgttgctgaaacaatctgagcgtgaccgaaaatcaaatagctccaaagggtaatcataatcagattgcgggcaatgcggagtgtatcctgatctgttaaaaacaaagccagtatctgccgggagaaggtgtaaatcagcacaatcaaaaccccgccgatcaaataattcaggccgatcccgactttgatgacctgcttcagccggccgaattgattagctcctatggattgggcggcaaaaattgaaacggcgataccgaggcttaccgccggcatctgcacataactcgccacttggttgacaaccccgtaagcagccgtcgcgtttgatccgtaatgattgacaaatgaaatgaccgcaatttcagaaagtgacacgagaatcatattgatgctcgacggaatcccgagacggagtaaaagcgcgagcagctttttgtccattttaagagaacggagcgcagtccggtcaaatgccaatggatgtttccttttccgcaaataaaccatgagtacgataaatgtcacgatgtttgaaatcacggttgcatacgccgaaccgtaaatgccgaacttcggaagtccgaaaagcccgagaatcaataagggcaagagcccgatgtttatgactgtactgacgattaacgtataaaacggagtctttgaatctcccgttccgcgtaaaaatgtcgtatacgcaaaatataaaaacatcagcggcattgcgcaaaacaaaatgcgcgcatatcggacactgacatctattacgttttccggcgttcccatcagccgcagaatatcaagcgtaaacacactgccgacaactgccagaacaacaccgagcataaaggtaaaagtcagtgtagtgccgacaatcgccttcatcctctcttcgtttttcgcgccgtaagcctgcccgatcagaatggaacttcccgaaccgattccgatcgtaaaggagatcagcagaaaaaacagcggaaaaaaagacgatacggcggcaagcgcatcaactccgagccaccttccgacaaataccattccgaccaattggccgacagattgcaatacattgcttaaaagcagcggcactaaaaacagtgacatcgatcgccagacagactggccgcggccttccgctgtttctaaatgatcttgtacttccatatgtaggactccttttttgattttcttccattttattattcagcagacagcttgtaaaaaccttttgttcaatgaaactctttatctttttctcacgtcttacatggaaataaaccataaaaataaaaagtccggaaaatatttctgaaaaggtattgtaatcttaccgtaattattgtaacatttgtaacataagagaaagagattgattgaaggagagattatatcatgaaaaaatggctattattcctcactactattacattgattctgtcattgggcactgcggcgaccgccaaaaatgcatctaatgaccttacacaaaaacaagcacttcaactggccctgtcagcgagagaacatttctggaacacgatgagcggcggtgcgcttaaatcaaacgcaaactgcacatctgaaccgtttgaatatcaaaatcttcaatacgtctttatgtgcaaagacctcggaacaaaagcgaaagccgtaaaatatctgacacccgcttttacaaagcaagcgattgacaaagggctcaaagattaccacttcactgtaaaagacggcaaattggctgttccggtcggcgacggagataacctcctgaattggaaaaaagcaaaaatgactcttctttctaaaaaaggaagcgttcaagcataccgcttcactgtaccgactcttgacggttctccgtcagcaaaacgcgatgtaacattcgtaaaagaaaacaacgtttggaaagtcaatcaatttgatgctgtcatataagaaaaagcccgcttgcttacagcgggcttttttcacatcatttccaccaggttcttgcaaaatattaaactcaaaaaccccttgtataacaaggggttttctgttttgccgacattattaatatgcgcctatcttatacaaaaaacgctctaggagagattcgaactcccgacctgcagtttaggaaactgctgcactatccgctgtgctactagagcctgcttctattatagtaacgctggcggccgtttttttcaagcctacagccctccgaacactttataggcggctctcgtcgtatcttcatctattccgatataacgcattgtaatagacggagaagaatgattcaaaatcctctgcagttcagcaatgtcttttgtcctctgataaaaatgatacccgaacgtctttctaagcgtatgcgtcccgatttcctccaatccgcaagcggctgccgcttcctttaatattctgtatgcctgaatccgggaaataggcttattcgtccgtttcgatttaaacaaatagtcatcctctttcatgtcttttgtataagcgtatatgtcggcctttaaagactccagtatcagaatttttcttttctttctcgttttgctttcggttgcccacacatggtctttgttccttacatccctcacgcgaagcggcagaacatcagaaatccgcagtgcgctgttcatgccgaaaataaataaaaaataatcacgatcacttttcttcattaaatactgtttgacttcctggatcttctccaaacttcggatcggctgtacgatatgcatcaaaaaactccttataattggtaaagtaacatattgagcattatgttactattatagccgaaacctgttgaatgataaaggatgaagggccttatgtaacataatatacatagtgttacataaggggaataaggcacgcagtttcatcgaagtcttcaaaaacatcattttcgacccgatgacgggattttaaatcaatagagactcacggtattaaaaaagaaaaacaatgcccttaaaacaaaatctgagcattcgtttttttgtgagcaaccgaaaaaaaatgaaaaaaaagacacaatatgaaattgtgtcctagtcttcatcttttacatcaatgtcttcaggaagcggctcatttaaaaactcttgaatcatttccttatatttttccagctgttcgagatgggtttgaaattgttccttgttgattaaatattgctgtccgtcatgtacggcccttattttattcgtcaaaacaagattgtgcacatattcttcaggaagactggtaaactcagctgtctctttgatcgttaaatacatggctcacgttcctttcatatgtcatgtgagtgaattctgttttgtttattgtagcttattttttgtctttatgcttgttttacagctttttcagtccggtttcccatttagcctatttgagactgattacattcacacagaaaccccaactttttgcacaccggactattccgtttgtcacttgtgaaaacagcacattttacttactctataattgtaagcggaaaacaaaggaggcagactatgaaaaagaaaaagtttatgaatctctgttttatcgttctgctcagtactttgctcgcggccggaagcatcccttatcacgctcaggctaagaaacacccgttttcctatgacgactacaaacaggtagatgtcggcaaagacggcatggttgccaccgcccatcctctcgcttcacaaatcggtgccgacgtgctgaaaaaaggcggcaatgcagttgacgccgcggttgccattcaattcgcattaaacgtaactgaacctatgatgtcgggaatcggcggcggcggatttatgatggtttatgatgcgaagacgaaagacaccaccattatcgacagccgggaacgcgcaccggcaggcgcaacaccggatatgttccttgacgagaacggcaaagccatccctttctccgaacgcgttactaaagggactgcagtcggtgttccgggaacattaaaaggacttgaaaaagcgctcgacaaatggggcacacgctccatgaaacaactcatcaccccttccattaaacttgcctcaaaaggctttccgatcgattcggttttagctgatgccatctcagattataaagacaaattatcacacaccgctgcaaaagacgtgtttcttccggacggagaacctctgaaagaaggagacacactcatccaaaaagacttagccaaaacatttacagctattaagtacaaaggcacaaaagcattctatgacggtgcattctccaaaaagcttgcggaaacagtgcaggaattcggcggctcaatgacagaaaaagatattaaaaacttcaatgtgacgattgacgaaccgatctggggagattaccagggctatcatatcgcaactgctcctcctccaagctcgggcggtgttttcctgttgcaaatgctgaacctcctggatgattttaagctttctcaatatgatatccgttcttggcaaaaatatcagcttctcgcagaaacgatgcatttggcttatgctgaccgcgccgcatttgccggggatccagaattcgtcaacgtccctctcaaaggcctcttgaatccagattatatcaatgcccgcagacagctgatagatattgataaagtcaataaaaaaccgaaagccggcgacccttgggcctatcaggaaggttctgcaaactataaacaagtgaagcagccgactgacaaacaagaaggccaaacgactcacttcacggtaaccgaccgcttcggcaatgtcgtatcttatacgacaacgattgaacagctgttcggttccggcattatggttcccggatacggcgttgtgttgaataatgagttaacagacttcgatgcggtgcctggcggcgcaaatgaagtgcagccgaataaacgtccgctcagcagcatgactccgactattttattcaaaaataacgaacctgtcctgactgtcggctctcccggcggagcaacgattatttcttccgtcctgcaaacgatcctgaacaaagttgagtacggcatggatctgaaagcggcggtcgaagagccgagaatttacacaaacagcatgacatcctatcgatatgaaaaaggagtgccggaagaagcccgcacaaaactgaacgaaatggggcataaattcggcagcagccctgttgatatcggtaatgtgcaaagcatcctgatcgaccgtgaaaacggcaccttcaccggagttgccgactcaagccgaaacggagccgcaatcggcgtaaacttgaaacaatataaaaaataactagacaaaaagcctcgtttctcaagctgagaaatgaggcttttgtttattctgcactgtattcagatgaggatttttcagatgttaacgaggcaagtaaaagcacgccgcacatcgcgatgacaacacccgctgatccgatccatgtcactgacgcaagagacagatgagtgacaacaatgcccccgatgcccgccccggccgccatagccagctgcatcacggactggttgaggccaagtaatacacccgatgattcaggctccatcgttgccaaatgatactgctgagcaggtcctgatgaccaggcggcgaaggaccaaaaaataagcactgccgccgctccgaaagcagaatgtgtgacaaacggcaataacatgagcatgatagcatgaagcgccattccgccggttaatgtcatacgcgccccccatttgtctgcactgaaaccgcctgctttagaaccggcaagacttgcaacaccgaaaataagcagcaatgtactcagtattccgctgccgatatgagtgacgttcagtaaatacggagaaaggtacgtatacgcaaccgaatagcctccgagccaaaaaaacgtaatagccagcccgacagccacctttcgtttcttcaaaagagaaaattgctgaatgagcggcaccggtttatctccttttatctcaggcaacgcgaaacgtataataagcatagcaatgattccgattgccgcaattccggcgaaaaccaccttccagccgaaagcttcagacacggttcttccgatcggaacaccgataatgagcgccgccgtaaaccccataatgacggttgcgagagaacttgcctgttttcccgggggagcgatttttgctgcgatcgtaagcgcggtgaccaccacagttcctgctccaagcgccatgatcacccgggctgccgcaaataagccgtatccctgtacgagaaatgaaatgatatttccgattacaaacaatccaagagcatagatcataagcttccttctatccagttttgctgtaagggccatcatgacaggcgttccgattgcataaacaagtgaaaaaatcgtaatcagctgcccagctgctgccacagtaactcccaaggaacctgcaattttatcaagcatgccggatatcacatattcagacgtccccactaaaaagctgataattgccaaaatgtaaatcttccaggtattttgcacctgacacactccttcattgatgatttatataaagatatattgtgatatatcgatataaagagttgaacaaacagaaacaaatcgcaatatgtcgatgtgtaatcggaaaaagaaactgaatccctcttctaaaggattcagccctacatttcgcgctgaaaataatcggccatcgcctttatcgcatcttcatctcttttataataggtgtatttgccaatccgttttgtttggataaggcctgcccgctgaaggatggaaagatattgagacgccgttgactgtgtcatctgaagcttatcggtgatctggctgacacatactccgatctcattcatatcaatgccatcatgcggtgcgaagtgacggtccggctctttcagccactgtaaaatctcaagccgtgactcattagacaacgctttaaaaacatcaataggtttcatacgctttattatatcgtgattttacgatatgtcaatgttatatttcttgaatctctattttttgttttgtctctcttatgatccgggaaataaaatcactcacattctcttcaaatgtgttttcccgcccgtattgccttacatgtacagaatggtggcggcactcttgatctcccacaaccgcaatatacggtatttttttcatttgtgcttctctgattttatagccgagtttttcatcacgctgatcgagctcagcccggatacccgctttcttcatttgcaggtgcacctgttctgcgcagtcccggtgtgcggtgtttgagactgggatgatttttgcctgtaccggtgcaagccataaagggaacgctcctgcgaaatgttctgtaatgattccgagaaatctgtcgagagaaccgaatactgcccggtgaatgacaacaggacggactttttggtttttttcatcgatatatgttaaatcaaatttctccggcatttgaaaatccagctggacagtggcgcattgatggctccggttcagcgcatcttttatatgaatatcaattttcggtccgtaaaatgcgccatctccccgattaaaccgaaaacggtatccctgttcttttaatactttttctaatgcgctctcagccctgtcccacaagctttcgcttcccatgtaatcttcaggccttgttgacagctcaatatcataggaaaaaccaaatgcggtgtacacctcgtgaatcagctgcagcgccgaagcaatttcactctcgatttgatcctgcgttacaaaaatgtgtgcgtcatcctggcaaaaagatctgacgcggagcaggccattaagcgccccgctgaattcgtgacggtgcacctgaccgaactcagccatccgaatcggaagatcacgataagaacgaagcttttctttaaatatgagcatgtggccgggacagttcatcggctttaacgcgaagcgctgatgatcggcttctgagaaatacatattctctttataatgatcccagtggccggattgctcccaaagacgctggttcatcatcataggggtgcgcacttcctgataatgataggcatcctgctttgaacgcagaaatgattcaagcgtgtttcggataaactgaccgttcggcagataaaaaggcatacccggcgcctcttcagaaaacataaaaagttgtaattccgctcccaatttccgatgatttctcatctccgcctctttcaacagctgaaaatgtctgttcagctccttttctgaggaaaatgctttcccatagatgcgctggagcattttttgattgctgtcgccgcgccaataagcccccgatacatgagtgagcgaaaaagcttttatctgcccggcagacgccaagtgcggacccctgcataaatcaatgaattcgctctggcggtatatactgattgtatcagtctgcggaatacctgctaagagctcaagcttcagcggttcatgagcaaacagctgctctgcctcttctctggagatttcttctctgataatttccggattttccgaaatgattcggttcatctctttttcaatgacggccaattctttttctgtaatcgtttcatccatatcaaaatcataataaaagccattgtcaataaccggtccgatccctaaacaaaccttcggatacagacgttttaccgcttgcgccaatacgtgtgctgctgtgtgtctcatcacttccagtcctgcttcagactgaaaactgcacagttcaatcgccgcatccttatgaatgcttcttctaaggtcatataacgatccgtttatctttccggcggcagacgcctttttcagactcggactgattgattgggcgatctcttctaacgtaacgcctttccggtattttttttgttccccgtcaggaaaagtaatcacaatgtgtggcttcttcacggtctaatctctcctttatttttaataaaataaaaaaacacactcatcccaaagcaagggacgagtgtgtgtcagacccgcggttccacccaaattcccgccactttaagtgacggctcatttttgccgtaacgcggctatacggtatcggcttgctctcgttcaccgatacagctcaaaaagcggtaagctcattcttcgtgccgggaaggtctcagccgcgccccccctctctgtatggccggttaaaatgtctcatgtccttatcattgctatttttcttatataaatataaaaacacactcatcccaaagcaagggacgagtgtgtgtcagacccgcggttccacccaaattcccgtcactttaagtgacggctcatttttgccgtaacgcggctatacggtatcggctgctctcgttcaccgatacagctcaaaaggcggtaagctcattcttcgtgccgggaaggtctcagccgcgccccccctctctgtatggccggttaaaatgtctcatgtccttatcattgcagattcctttatacgaaaaactttcttttattatacataaatttcccgaaaaagaaagttttttaagaaaaaccggaacgaaaaaaattggcgtacacagctgttctgttttctcattttccgttcgataatgtttttaatccattcagcagtgcttcaaacgccgatgtcaaaaataaatcactccggtagatgaatgatatattcatattccgaaaatgttcaggaagctcatgaagaaaaagatttttcctgttttgaaaataacggacggctgatgcaggcagaaaggagacccccatccccgcctgcaccgccccaataatggcttccaacgtaccgaattcaatgattttatgtgcgggcactgcctcttctttcagtatgttttttattttgcggcggtgcgaacagcccgcggcaaaatacagaatcggctctcgcagcaagtcttgcaaactgccttcccgcttatttgaaaccaagaccaattcttcttgaaatacagcgtcttgctcaagatcttcatattcgaccggtccgtaaacaaaagcgccgtccagctcatagtgtagaacgcgctgcactaaggtatgtgtatcaccggttgacagcgacagctgtactttcgggtagcggctgcaatactccgtgaaaaattgagggagatggacggctgccgccgtttcaagagaaccgattcgaagcgggccgttcggatcgcctgcctcttgcgccgttttttgcgcctcatgcagcaattgaaggattctgtctgcgtcttttaataagttttcacctgctggcgtcagcgtcattccccgatttgtgcggtaaaaaagctgtgtttgcaattgccgttccagctgctgaatccggtttgtcacatttgattgaacataatgcaggctttctgccgcctttgaaatacttcctttgcgggcgacagcctgaaaaatctttaagtctccgctttccatgtaagggcaccttcttgctatgatttttattgatagccggctatcaattttcatttatttactgcagctgatacagcctgtaaaatttttctcatcaatcataaaggagagaagaatcatgaatgcccttatcatacacgaaaatggctttgatttcaggcaggcacctgacaaaaggccgggaaacggcgaagtaaaaataaagctgaaaacagccggattaaaccatcgtgatttgtttttaatgaaaaaacacgaaaccggaaaccatgaatttattctcggttcagacggcgcgggaatcgtaaccgaaataggacacggcgtccggtctcatttactgaatgcagaagtcatcatcaacccggtgctgaattggaagactgttgaggacgtaccagccgtccctgatattttaggcggtccgagcgacggaacattttcaccttatgtcatcgttcctgcggaaaatgccgttttaaaacccgaacacctgacttgggaggaagcgggcgtcctgccgttatcagcattaaccgcttatcgcgccttatttacaaaaggacaattaaaaaaaggcgaacaccttatccttccgggcatcggaagcggcgtggcaacatatgccttattaatggcaaaagctatcggagcgacagtcagcgtcacctcccgcagtgaaaacaaaaaacaaaccgcactgtcatacggtgcagaccgggcgattgacagctacggtgactggaatgaggcgctgaatggcgaaaaagcagatatcatacttgacggtgtaggccccgccttatttcaacactatcttgacattattaaaccgaatggccggatcgtaacattcggcgccagttcaggcgatcagctcggatttcccattcgctcgctgttttttccgcagattcatattctcggtacatcaatgggaagcaatgaggaattcgcggatatgctggaattgataaaccgctgcggcatccgtcccattatcgaccgcatataccctctcagtgaagcagctgccgcttttaacaggatgcaggaaggacggcagttcggcaatattggctttcgtgtagatgtctaaaaaaaggagcggacccgtccgtttccttatttgtttaatagcgtttccgcttgaaattcaaaatgttgttcttcatcgattaaaatctgcccgcaaatcgactgcagacacacagagcccgtcacgttttttaaggcgtcataataaacggcggcgatgacttccgccgtcagcagcaccgtgatcgacagctcaaggcttgcaaatcgtctcagtctccggaagaaaacaatctctccgctctgtaaaacaaaattccatatttatcttccatttccatatttcctttatatgaccaatacaagaagaaggaggttccatttcaatacgaaaaaccggctgttcccagccggttttataaataaacccctttatttacggtaaaacagtgctccccattaaataactgtcgacttcgcgcgctgcttcccggccttcattaatcgcccatacaatcaggctttggccccttctcgcatcccctgcggcgaaaacaccgtcaacattcgttttataatccccatatgccgcctgaattttatgatttgccgaatcgacaccgaactgtttcaataatggctgttctgttccttcaaaaccgatggcgatgaacaccagctgagcaggccagactttttctgtaccgggcagttcatgaaattcatactttccgaattcgtttctgactttttccatttggatggtgtggatctcttgtaagcggccctgcttatcggccaccatttttgtcgtctgaattgaatattctctcgggtctttgccgaactttgcctgcgcttcttcataggcgtattcaagggtaaagacgtgcggctgttcaggccacatattgtcgttcgtgcgcgtctgaggaagtttaggatgtttcccgaactggtgcacgctgcgcgctttttggcgcagcgcggttgccacgcagtcagctcctgtgtctcctccgccgatcacgatgacatctttccctttagcgtctataaattgtttgtctttgaagttggaatctaaatagcttttcgtcgccagtgttaaatagtccatcgcataatggacgccttttgcttcccggccttcaatcagcagattgcgctgcttttgggcgcctgtgcacaaaatgacggcatcaaattgttctttcagctcatctgccgttatgtcaacgccgatttcggtatttgtcacaaaatctataccttcctgcgtcaaaagcttaatacggcgttcgacgacatttttctcaagcttcatgctcggaatgccgtacatcagcaggccgccggctctgtcggcacgctcatagaccgttacggaatgaccggcttgattcagctgatcagcgcttgccagacctgccgggcctgaaccgacgacagcgacttttttacctgtgcgtttcacgggaattctcggctgaatccatccattttcaaaacctttgtcaatgatcgtccgctcgatgtttttaattgaaacagccggatctgaaatggccagcgtacaagatccttcacaaggagcgggacagacccgccctgtgaattcaggaaagttattcgttttcagaaggcgctccaaggcttctttccagcgcccccgatagacgaggtcattccactccggtatcagattataaatcgggcatccggaggtaaaaccgttgatatcagcgccgatttggcaaaacggtgtgccgcaatccatacaccgcgccccctgccgctttgacgcttcatctgaaaatggagccgaatactctttccaatcctttaagcgagtgagagggtcccgctcagccggtttttctcgtttttcttccatgaatccagttggtttccccatgttcctctcccctttcttactgtactaccgcttgtttttgatctttggcaggcgtttggaggacctttgtattggcttcaaaagcatacataattgcgtcttcttctgataaacccgccgctttttgttcttcgatgctgaggagcatttgtttatagtttttcggaatgattttgataaaggtttctgcggctttttcccaattgtccaggagatctgcggcttttttgctgtttgtcagcgccgcatgccgtttgaccatttcttgcacttctttgatctccgcctcatccgtcagcttttcaaatgaaatcatttccatgttgcatttgcgtttaaatgctttggcatcttcactcaggacgtatgcgataccgcctgacattcccgccccgaagtttttgccgacttcgccgagaacgacaacccggccgcctgtcatgtattcacagccgtggtctccgataccttctacaacgacattgactccgctgttacggactgcaaaacgttcaccggcgcgcccgttaatgtacgcttccccgcttgttgctccgtaaaatgcgacgttcccgataataacgttatcgtgtgtttcacaattgaaggcatcaggcgctttcacgatgatttttccgcctgaaagccctttgcctacgtagtcatttgaatccccgttcaaatgaagcgtcatccctttagggacaaatgctccgaaactctgtccggctgatccggtaaaatgaagtctgatcgtatcatccggcaggccttccgctccgtagcgtttagaaatttcacttcccgtcacggttccggctacgcgatttgtattattgatcttgatttcagcttccgcttcctgaccggcttcaattgcagcctgcaccgccggaagaataaccgtcatatcaagcgactcgtcgattttatggttttgcgccgtacggaaagtgcgtacgccttcaggctggtacagcagtgtggataaatcaagctgtcccgctttccaatgcgctttcgcacgttcactgacatgaagaacgtctgtccgtccgatcatttcatcaagcgtcttaaagcctaactgcgccatatattcacgcacttcttctgcgacaaacagcatgtaatttacgatatggtcaggatcgcccatgaattttttgcggagctccggattttgcgtcgcgacacctacaggacatgtatctaaatggcaggcgcgcatcatgacgcagccgagaacgacaagcggcgctgtagcaaagccgaattcctccgcaccgagcaaggcggccatcacgacatctcggcctgtcatcagcttaccgtccgtttccaatactacgcgatcccgtaagccgttcagcatcagcgtttggtgagcttctgcaagaccaagctcccacggaagacccgtatgtttaatactcgttttcggcgatgcgcccgttccgccatcgtagccgctgatgacgatgacatccgcagtgccttttgccacaccggccgcaatcgtgccgacaccggcttttgacacgagcttgacgctgattcgcgcgcttcgatttgcattttttaaatcatggatcagctgcgccaaatcttcaattgaataaatatcatggtgaggaggcggtgagatcagccctacacctggtgtagaaccgcggacatccgcgacccaaggatatactttgttccccggaagctgaccgccttctcccggcttcgccccttgcgccattttgatctgcaattcatccgcattgacgagataatggctctttacgccgaaacggccggaagcgatctgtttaatcgcacttcttctgtcgtcgccattttcatccggaacgaaacgtttcgggtcctcgccgccttctccgctgttgctttttccgccaagcctgttcatcgctatcgctaaagcctcatgggcttccttgcttaatgaaccgaatgacatcgctcctgttttaaaacgtttcacgatggacgcagctgattcaacttcctctaattttaaaggcttgcggtcttctttgaaggcgaacagattgcgtaaaaatccgattcgttcttcatccgctgcttgagaatactgcttaaacaggctgtaatcattttttcggcaggcccattgcagcgtatggatggttttcgggttgaaagcgtggtgctctcccccgttccgccattggaattcacttcccggatcaagagtttggctgtaatcatccttgtacgccgcttggtggcgctgtttcgcttcttgcgcaatcgtctcaatatcgattccgccaagctgagatgcagtaccggtaaagtatttggcgataacgtcttcaccgatgccgaccgcttcaaaaatttgggcgcccctgtaactttgcacagttgaaatccccatttttgacatcactttcacgacgccttctgttacgctctttccgtatttgctgacagcttcttcatacggaatatcaagccggccttcatcgatttcctgcttatacgtagcataagtcaaatacggattgacagcatcggcaccatacccgatgagagccgcaaagtgatgaacttcacgcgcttccccggattcaacgataatgcttgcttttgttcgcaggccttgacggatcaaatgctgatgcagcgcactgacggccaaaagcggcggaatcggcgtcaattccctactcattgccctgtcagataaaattaacagagatacgccttccttgatcgctttttccgcttgctgaaacaaatccttcaggcctttttccaggtcatcggaaaacagcgtgcggatgttctggctcttaatgtcagggtgcacaagtgttttcagcgcataaaactgttcgtttgataatacaggagtatacaattttatgcggcgtgcatttctttcactcggatgcagcagatcgccttcagctccaagccatgtcaccgtagaggtcacaagctgctcgcggatcgcgtcaatcggcgggtttgtgacttgcgcaaacagctgtttaaagtaatgaaacagtgattgggcgcgatcggataaaacggcgagcggcgaatcatttcccatagagccgagcgggtccttgccttctttaataacaggaattaaatacttctgaatatcttcatacgtatagccgaacgctttttgacggacgagaagatcatcgaattgttcctcttcccggatttccgggtcaggattcacttgaaccaattcttcttcaagccatttttgatacgggaattcattggcgatttctgtttttacttcttcatctgaaataatccggccttcctctaagtcaatgagcagcatttttccgggctccagacgttttttatgaagaatgttctcctgctccacttcaataacgccgacctcagatgagaaaataatatggtcatcttttgtcacatagtaacgtgccggacgcaggccgttacggtcaaggatggcgccgatctgttttccgtccgtaaacgaaatggcggtcggcccgtcccacggctccattaaagagctgtgatattcataaaaagcccgtttcgctttagacatgtgagtgttttctgtccatggttccggaatcagcatcattgccgtatgtgccggtttccgccccgccatcacgaaaaattcaaacgcattatcaagaatagatgagtcactgccctcagcatttaaaatcggcagcactttgtgaagatcgtctccgaagctttctgaaacgaactgctgctccctcgctctcatccaattgatgttgccccgaagcgtattgatttctccgttatgaatcagatagcggttcggatgggcacgttcccaagtaggaaaggtatttgtgctgaatcttgaatgcacgagtgaaaatgcagatacgaaggtttcatcctgcaaatccaaataaaaagcgtcaacctgctcaggcgttaacaaccctttataaacaatagtctggcttgacaagcttgcgaagtaaaaatcaagctgttcttgaacgccccaattttccgcctgcttccggatgacatacagtttgcgttcaaaagcaaggctgtctttcaaatcgtttgcggctccgataaatacttgacgcacatacgggcaagtgctttgtgccactgttccgatttttccgacatttacagggacggttctccagccgagaacaatctgtccttcctgctcaatgaatgcattcacctgtttttcgatcttttttctttcctcttcattttgcgagaaaaagaccattcctaccccgtaacggcctttttccggcagcttcatttctccgcactctttcttaaaaaaagcatcagggatctgaaccatcaggccggcgccgtcacccgtattcggatcactgccctgtcctcctctgtgatccagctggcaaagcatcttcagtccttttttgacaatgtcatgtgaaggtttcccttttaaatgggcatacaagccgattccgcatgcatcgtgctcaaattccggacggtagagaccttgtgctttcggcatttgattgtaagtcataattcctctcccccgatcagtttccgttaattatcggtcataaaatctgacaactttaaattaattgtaagttttcaaaacaatataaacaatatataatttagatcaaatacatctcaaaatgagatagatgggtgtgaacgcaatggaattacgccagcttcggtattttatggaggtagcagaacgggaacatgtgtcagaagcggctgatcatctgcatgtcgcacaatccgccatcagccggcagattgcaaatcttgaagaagagctgaaagtcactttatttgaacgggaaggcagaaatattaaattaacgccgatcggcaaacaatttttagaacatgttaaaaccgcgatgaaagcaattgattatgcgaaggaacaaattgatgaatatcttgatccgaatcgcggaaccgtcaaaataggatttccgacgagccttgcaagccagcttttgccgactgtgatttcggcatttaaagaggaatacccgaacgttgagtttttgctccgccagggttcttataagtttttaatcgaagcggtaagaaacagggatatagatgctgcgctgctcggccccgttcccacggaattccccgacataacaggcaatatcttattcacggaaaagatttacgcgcttgttccgctgcatcatccgcttgccaaacagaaaaatattcatttaattgatctgcgcggcgaccaattcgttttatttcccgaagggtttattctccgaaacatggcgattgacgcttgcagacaggccggctttgcgccgcttgtatcgacggaaggcgaggatttagatgccattaaaggattagtctccgcggggatgggagttactttattacctgaaagcacctttgcagaaaccacaccccggttcacggtcaaaattccgattgaatttcctcaagtgaagcgcaccgtaggcattattaaaccagaaggaagagaactggctccgtctgcaaatgatttctatcattttgtcattcaatttttctccaaacttgaacaatatcaataaaaaacaaacccgagcttcaaaacgaagcctcgggctttttcatatttttatagatctttctcagccgatcggaatggatagttcaacgtggcagacaaacgcttccggatcaatgactgattgatcggtctgtttgtgcggcgtttctttaaatgtcttcagctgggctgaggaatagttgacgatgccgagtccgagctcttctccctgctgatcaagcagcctgacaaccgctccgctgctgaatctgcccttaatctgttcgatatcctgcggtgacagtgccatatttccgttcgcgacatcgttgctgcttttcttttccatcacaatttcgccttcggggccggaattaaatgcaagccattgttctttgtggtttaacggcagggttccttccgcttcaaaataagttccttcagccgcctcatctaccgcttgaagcagaatgtccgggatgttagcctgcccgagaaagcctttaataccggaggccatcacaattttaaaagcatccagtttcgaacgcattccgccggttcccatttcactcccggcatctcccgcgcttgcttctatttccggagtgatgtcgcttacatgtctgattcttttcgctttcgggttgctgcgcggattatcatcatataaaccgtcaatgtctgataaaattacaagcatgtcggcatcaattaaacctgccaccttcgctgcgagtgtatcgttatctccgaatttcagccggttgactgtgaccgtgtcattttcattaataatcggaataatgcctcgttccaaaaggacgttcatcgtattgcgcacattatggtagcggtattcatcggaaaagtcgcttcttgtaattaatatttgtgatgcgacataaccgtgcgctaaaaacagctttgaataagcctccattaataatccctgcccgatggaagcagaagcctgtttttcagggaggccttctggtttctgaataaatccgagcttccgataacctgccgccactgcgccggaagatattaaaatcacttcatagccgctgtctttcagctgtgcgatttgatccaccaatgcttccagctttcttctgctgatttccccgtgcaggctcgtcagtgagctgcttccgattttcaccgcgactcttttgatcttcgtccgagacgtcactgtatcactcctgttttttaacgattatagtgctgccgttttttcaattgttttgctgatctcaatagaacgttcggtcgcatgtttaatggctttggcaatggcttctccgccgccttctgacctgagcgcatcgaggccggcttccgtcgtgccgtttggagaggtgatgttttcccgaagcacatccggtttttcacccgtttccatcagcattttagcagcgcccaataacgtttgcgcgccgattttgcgggacagccgtttgtctaagccggcttcttcacctgctttttcaataaactccattaaataatagaagtacgccggtccgctgcctgcgatgccggtgaaaatgtccatctgatcttccttgatcacgtacacttccccgaggcattccaaaagggataccgcggtttttgctgaaccgtaagagacatggtctccgaaagccgcagctgttgccgattcgccgatcatgctggatgtgttcggcatcactcttacaactggctgacggtcatgtaatgattgttgtataaatgaggttgttatgcctgccagaacagacaggatgatttgatgaggttgaatacgccgtttcagcgtagcaagagcgatttcagcatccttcggtttcatggctaaaataaagacatcaatgtcttcggttttcatgctgtcaaaagcaatgccttgaattccgtattgatgttccaattcagcgagtcgctctgtattgcggcggtttgtcacgcagatgttttggttgggaattttttttgcgcggaccatgcctgatatcattccttcagccattgatcctgctccgataaaagcaactttcttttgatctaagatcggtaacatctcccttgttcgtattttgttcgtatttttcacacgttttttatgttaccacttcaggagtcgatgtcaagtttgaaggttttattgatatgtattgttccgagcctgttattatgtataatgaatcacagaacaaacctttagagcccgggaggccgggtgcgttccggccggatttaaaaattatctgaaatggctttttctatcagctttttgcagcggtcaagctctgtcttcagctgttttttgtaaagcttcgctgcttcatagtctttaaattgatagagaacgacttcctggagtttggctccctcctttttcacttttacttgctttaaaatcccgtcatccaaaagttcgtgaagtgaacggtacacctcggtatgattcggcttaaaaccgatgggtttaaattccgaacgcagcacctcgagaagcttcagtccgtaaagccgttcctgctctgtcattgtaatcatgtaaagctttaaaaaggctctttgtttcactaaaaaaccggttgaacttcttttttcttctttcaatatgtgcacgcccttccttctaacaaattattccatgtactaaatattctctttatatcccgttttcccttttattgttcggacagtttggtttgtattgatttgttttttggatgcggggaaaaataatcttattgaacatttggtacatagtttatttagtttaattatagctgatatcggtttctttttcactcttttttctgcaaaaacggatctttatgcctatttaatcgggttgcggaaacaaaaaaagacccgtcacgaagacaggtccccttttgtttaaggattagttgaccacaaaccggccgttttgatgaaaatgcgcggatgtaatttcaattgagcaaccatatattctgcaagatcctcaggctgcatgactttttccggattgccgtctgtcagatttaattcaatagacatgtcgcttgcaaccgtgctcggagtcattgcgctgacacggatattgtgttttctgacttcctgcatgagagattcggtcagaccgagaacggcaaatttagaagcgctgtacgcacttgtcgccgcggcgcctctttggcccgccgtagaagaaatattaatgatatctcctgattttctctcaatcatttcaggaagaacggcgcgtgtcacgtggtatacacccattacattaacttgaatgatgtcttcccactcttcaggcgtaagatccaaaaatccgccgaatttgctgattccggcattgttaatcaggatgtcaacctcaccgagttcttctttaatagaggagacggcttgttcaacctctttttgatttttcacatcggcagcagcgaatgatgcctttacaccaagggctttcacttcttccgcaaccttttcgacatttgcttctgtacggccgattaaaccgatattgactccttcttttgctaaagcgatagcggcggcgcggccgattcctctgcccgcaccagtgataagagccgttttgttttgtaggctttccatgtctttcaccctttctgaatgtccttatgtacgatttcacattataagcagaaaaaaaacaattagcaaataaaatgattcagcacgatccgtaaagggtatcaactgaaaaaaaggagtgaaaagcagatgatcatcattttgtatatcagtgctgccgttgcggctgccgcattaatttatgcagccgtatccgccgtgcattttaaaagaaacacagcgcctgatataaagaagattaacgccgcgacagcgtctatgcagacgtccgttgaagaaatcaaaacagaaacccgtttgttatcacaaaagcagaaagaactgcaggaagactttcttactaaaaaaacagccgtgcaaacgacggcagccgaagttaaaggaacgcctcacgtcctgaaaatgctctggaacgccggtaaaagcgatttatgagcctgcatgtcatccgacgtttttgatgacactaagagaaactggcggattcaaggaggcataacatgatttgcgatcgtgagcggcttgcgcattttttgcagcagcttaaagcattatcatcttcgggagggtttacaaaatcggatttgctgactccggagttccatttagccaaggacggatatctggatatgtattattcgcctcataatgagtatatcaacccacatgctgcggttgtcatctccggaattacacccggtttttttcagatgcagcgggcttacaaagcagcggcacagcttttaaaaaacggcgaatctcttgaggtgatagcatatgagacaaaaaaagcggccggactttccggttccatgaggcagcacatcatcgaaatgcttaatgaatgcggtctgccggccgcgcttcacgttgaggattcatcccggttatttgattcaaaacgggagctgcttcatacgacatccgttattaaacaccctgttttttataaacagaaaaactatactggacatcggccggcaatcagcagatcagctcttctcagccgttatgcgctgacatgttttccggatgaaatagaaatgatgaaaaaggacattctgctcgtccctctcggtaaagcagcagaatcagcctgccgcatgctgaagaagaacggcagaatgggccatgcggtcattctggaaggcttcccgcatccgtccggagcaaacggacatcgtttcaaacaatttcacgaaaaccaacaatcgttacgtgaacaaattcagcggtttgccgggtttcttcagaagctgtaaaaaaacgccccgaattttcggggcgctgctgttaagaagcgtattcaggcaatgctttattgtgttttgccgttttctcttcaggtattttgatttgatttgtcaagattgcacttacgaaatagagcgctgcgaaaatccatacaacgccttgtgcgccgacaagcccgatgaacgcccaggcaagcgcggggccgacaaatgccgacaggcccgcagccagatttaacacagacatggcagcacctttattgctgccggccgccgtcggcacgatagccccgatcggaacgaacccggcgaggagccctccccatataaaaccgactatgctgacgaaaagcaagttcccatgtgatacaacaggagcataatataataaaagagtaaaaatgccgcagcccactcctccgaaccacatgacggtctttttccagccgaaggcatcgccgactgcgccgaatattaagttaaaaacgatatttccgagaaagatcgttccccaaatttgaagccatacatttgtagaaatgccgtgctgcgccatatgcatcgggaggaataccggaaatccgtatgttccgatgctgttaatgatccgaatgatccccccagagagcacgcgcggattttcagcaaggatggtgattcccttcattaattcctgcgccttttcccgcttatctgcctttttcttttcaaagcggtccctatttaaaatcaaagcaaaaaacgcgccgaggcatacccagaaaattgaactccacagcgtattcaaatagccgaaggatttgatggcccagcttgaataccaagcaccgaatacaaacatcccgcagcaatatgcaatccagaaccagccgaccgccgtactgagcctgtttttcggcgaccggtaaatcacccatgtcaaaaatgaataggcaaacagcgggtaacccagccctttaataaaatacgtgacatacatcaccggcaaattaagattctcaaatccgtatgcgataaacgcggctgttccgatgacgtaaaacaacagccccataaacatcgtccgctttgcgccgaaggcttcgaggcagacccctgaaaaccacgacgccacagcaagagaaataccgtaaaccgtaaacaaggatgctgattgctgtaccgtcaagccgttttcaactaaaaacgggctgagccagccttgttcaaggccgtcccccatcataaacagcacgacccctaaaaatccccaggcgagctgtttcggaattcctattttattaagcatttttgttcctcctcagcaatctttcatgttgtcatctcatccccaagtcaggctttcaccgccggctgaaaatgagtaaataatttttgcgcatgtttccattcttcatataggaagagatccgtctgatccgcttccggctcaattatctttgtgcgggtcgaaagctctgctttcacaccgagagcttcgttgcaaatcatcaccgctcccattgcggatgcctggctgaacccctctctcttatagattttcttttgaagaaggttagcaagaaactgcgtcaaagcatcactttggaaaccgccgccgcacaccttcacataatcttgtgaaaaggaagccgcctctgttaacgcctcatagttccatttgattgaaaaagcgatttccagcagtgcggctttaacaaaatgggctctgcttaagttttgggacagcggagcgtcaaatataaatccgccttttgccagtgcgtttttctcaggcgataaataggagcctaacgcagaaatacaggcatgatcatgtttcggcagacttgcgatttcccgttccatgacgctgtaggattcattcggataaaaaatggattttaatttttgataattgagtcctgttacacccggattcgtttcaagaagccattgaccttcttctgtatggcaattcagccatgcattctctaaactttcggttccggtctccgctgttatctttgtaatcggcgtcgttgtgccggatacgatgacgatatctcccggctttgcatctgcacttttgatggcaagctgtgtgtctcccccgcctgcaatcacaggcactctttcagaaagaccgagcaccgccgctttcttaaacgttaacattccgacaaccgtcccagatcggacgagtgaaggaagaatggcagaaggcacaccgaagatgttgcataatttctctgaccacgcctttttccttacgtcaaacagcagtgtttcagcagcctgtgacggttcatagcttaaaattccgctcagctcaaatgtcacccagtcactgacgcttgtgatgtacttcacttctttccataaagacggctgtctggcttttaatccgacaagtttcatggcggaaaataaagcgctcggaagacgtccggtttgctgatgcacttcttcttctgcttcaatcccgccttcccattcacgccctctgttatcaatgttgggcagaccgagaaatgcctttttatctttattgatcagaacgattccctgcctctggcttgttgaggtgattccgatcaatgtaatatgagggctcttggcaatagcctttcttgccatagcgctgatttgcgtccataacccttccggtgagaaatatcgtccgtccggataaagcggatccgtcacatattcaatgtcttccctttcaagcgcggtcacttcgccgccggcagtcacgaccgcaactcgcgcattccccgtcccgatgtcaaatacaaggtagcctttttgttcagccattacagcctcctccttccgtttcaagttctcttttgttataaagttcacgtattgagcaggtttgatcttgtttccatttgaaaagcgcttcatttaaaatcttcacatgatgatcttccacttcaaatgttgcgcccgctaaatggggagtcgcgaacacattcggcaaagagatcaaatcataatcagaagattcaggcggttcatgataaaacacgtcaaggatcgctcccttaatccgccgttctttcagcacccgcagcagctcttccctgtctgtaaccgccgctcttgacgtattgacaaaaacagcttcctgtttcatcaattgaaagtgccgggcgccgataaggccgatggtttcttctgtgcgcggcaagtgaacggaaacaatatcactttcagaaaatacccgttcaatcgtcgttttttcatactcccggttttcatgacggacaaatggatcatagtaaagcaccttgcaatcaaaagcggccaatagccgggcgattctctgtccgacagcaccgaaaccgataaggccgactgttttccccgtcagctcatttcctctgaatttgacgtaagcctgcaaataatcaccattccacttcccgtccttcagccactgatgggaagaatacgtatgacgcaaaaatgaaatcacatttccgataaacatttcagcaacggcctgggcattgcgggccggtgtaaagaaaacggggatttttcttttagtcgccgccgcaatatccacattagacggcatccctctgcagacaccgataaaagcggaatccggcaatatgtcaataacacgctcagacacctcatcaagttcggtaataagccccgacgcgtttgtctcttgaatcattcggattaattcatcttcccgataggcccggccgtgcttcttccacggccggtgcacagtccggccgaacagctcagtcagctccttcagcccctcgtcgtgatatggcgcggtaattaaaaccgtcatggtgcaaaacatccttttcacataaattttttcataaaaaaaatctctttcctcaaagaaggaaagagattcatataccgtctttatacgcttgaagcgcacaaatatgtatagaccattctttcctatctttcaagcatacgcttgctggaattggcacaataaatgttgccgaggtttcatagggccagtccctccacctctctggatagaaaataaaatgatgaaattgtcaggctgtttaaaagaataaactcatcatagaaaagtctttccgtgatgtcaacacttttttctgaattgacgttcgattttgaaatgttataatgcttacattataaacaaagaggagaaatgggctatgaattctgctgcaacacagccgaacggggtctttaagtcggtgtgctccctagactgtcccgatcaatgcggcttgcttgtgacaaaaaaagacggaaaaatcattaacattcagggagaccccgatcacccggtcacatcagggaatatttgcaacaaagtcagacacatggctgagcgtatttatgatgagaagcgcgtaaccattccgttaaaacggatcggtaaaaaaggtgaagccgcgtttgcgcctatttcctgggaggaagcaatcaatacgatcagttcgcgctggaaagagcttattgccgaagaaggagcggaaagcattcttccgtacagcttttacggcaatatgggaaaactggcggcagagggaatggaccgccgttttttccatcgtctcggagcgagtcatctcgaacggacgatttgcagcaaagccggatctgaaggttataactatacaatgggagaaggagcgggtactgatccggaggagaccatacatgcaaagctctttattttttgggggatcaatgccgtcagcacgaatatgcaccaaatcatgattgctcaaaaagcccggaaaaaaggggctaaaattgtcgttatcgatgtacataagaaccaaaccggccggcttgccgattggtttattcccattcgccccggcacagatgccgcactcgccctcggtatcatgcatgtcttattcgacgaaaaccttcacgatgaagcatttctcacagaatacaccgaaggcagtgaagaattaaaagcgcatgttaaacactatgatccggaaacagtttctgctattactggcgttaaagccgacgatatcagacgccttgcgagaatgtacggggaaacctccccttcccttatcaggattggaaacggcattcagcaccatgacaatggcggaatgatcgtccgcaccgtcgcctgccttccggctgttacaggacagtggctcaacaccggaggaggcgcaatcaagcacaacagcgcggtattaaactataacagacaagcgctccagcggcctgatctgctttacggccggaagccgcgatcatttaatatgaacaggctcggaagcgttcttttagaaacaaaaccgcccgtgcgctccctgtttatttacggtacgaatcccgcagtggttgcgccggaagcgaataaagtcagaaaaggcctgctgcgggaggatttatttacagtcgttcacgatttatttttaacggaaaccgccaaatatgcggatatcgtgctccctgcttcatccgcttttgaaaacacggatttttacacgtcttactggcatcattttattcagctgcaaaaaccggtgatcgaaccctacggggacagcaaatcgaatacggaagtgttccgtctgcttgccggagcaatgggatttaccgagcaggagcttcaggattccgatgaagaattaatcagacaggcgctggactttcccgacaatccgtatatcgaggatattgattacgaggcgctctcacgccattcctttatgaaagccaaacggaaaaaaccgctttttccgggaaagctcaagacaccgagcggaagaattgaattatattcggaaaagatgaaacaggacggttatccggcgctgccgacacacatccctcttgagagcgatgacgattttccgcttttatttgtcccgggaccgaatcataattttttaaattcgacattttcaaataacgaaaaacacgtaaaactggaaaaagcgccaaaactttttattcatacagaagatgctgtacgccggaacatagaagacggagaaaccgttagagtttggaatcaccgcggagagtgcgaattgactgtttcggtcggcgaacaggtgcttcccggcgttgcggtgagccaaggtctttgggccgatatggatgataaaaaacagctcgtcaattcactcacgcccgatcggctggcggatatgggcggaggtgctgttttcttctccggaaaggtgcaggtggaaaagctcagcaatcaaaaccgtccgcaataaacgcccggcggttttgctgaaggctgaatccttcggccggcttcaccgcataaaaaatgattacgtttattggaggttgctgtatggatatcattaccggcatcggaatcgctttagccggatatttcataggagacggattgaaaaactttaaatcatctgatcctcatgaacacactgaccacattctcattaaagaaaaagatttacactattatattggttattatttaggagtaaccaaggaagaagcgaaacaaatcgtgcctgacacctctgacattccgcatatcacgagaaacggaaagcggtatgtgcagaagacggcattaagagaatggctgacttccatgctggaaaaagaataacagctgctatgaaaagcgggaagagtttttctcttcccgttcattaagatttgccgccctgcctctcttcaaccccaaacatacgacagatatcgttcttacgtaacgaaacatccccttctttagatttcaaataaaaccctttcttatataaccgtatgacttcctcatatgtaagctcatgacgaaggagcgccattaaacgcccgtctttttcatcttgtttattgaaccattcataccagttcactttctgcatgtcaaacaccttctcactttgaattaatgccttttcgcatttattatacttatttccccttttgtaaacactccgactgcctgtgacatttttgaaaacagccgtacccgtccctattagtcaccatgttgacttatttccctttgtgatgtatattgtaattgtcaacatggtgacaatttagatgggagataatttatggatattaaattactaatgaaggaactgcattttatacaacaaagttacgcatcattattttcggttgtcaataaggtgcagactcggggggacgaatacttagaaatgttaacttcccgacagcatatggctcttattgctattgcccatttaccgacggaagatgccacacttatgaatatcgctaaaaagctgggcacaacaaaacaaaccgctaacaaattaatttcaagcctcgcgaaaaaaggatatgttcacacggtgccaagcaaactggataaacgtgcaatcaatattgagattacccctgaaggaaaaaaagcgttaatttcctgttcagaaagatccacctattttttagcggatatgtttcatgagttcacaactgaagaagttgaaacattctggaggctattgcaaaaactttatcgttttgatggtgaagaacaggatggttttgaagaaaaagcacatttgaaagttgaagaccaggcacgattcatctcagatgactatgaagaaaaaatcatggctgaattttcaaaacggagatatgggagtgcagacgatgaataatatgctttatcgaaaagtaaaagaaacagaggataagatgaaggaaaaatgctatgagctgaaagataaaattgatcaatttatttctcacactaaatataaaattcattgcaaccgtaaactggaccgagccggcaattatatatcaattgccattggactctttatcctaactgcctcatggctgaccggaacacaatggctgctttggataggcgcggcgagtattttgagtaatgcctgtttgctcattataaagcctgttaaaaattgaaaacctaaaaaaaagctctctaaaagagagctttcttttattaatcgtcccagtcttcatcttcttcccgattttctttcatctcatgaaatctttcataaaagaactttataaaatgcgcagaattaagttctttatagccaccgaattcactccaaataacaactggacattctccttcccgttactttaagaacatttattcacaaagtaatcttttttacaggtcatttagtggtagcccaggaaaatgcgaatttacaaccttaatcaaattcaaacataaaaagtcgaattccctgtcctttaaggaaaacgacttcttcaagtaaatccccattaaccttttttggggacgatttgtaatctctgcgcagtgaaattatacctgtgctagcccgccatctacgaacaattcaacacccgtcaagtaactgctttcgtctgaagcaaggaaagatacagcgtttgctacttcttcaggtgtcccaacttttccagctggaacagtatttctgctattttccattacttcttcaagtgcatcaccaaaaagctcatcgtaggcaggtgtaagaatagctcctggactaaccacatttacacggatttcagtatcttttaggtcaagaatccagttgcgaactagtgctcttaatgctgctttagatgctccatatacactaaacgctgggttgccaattgatccagcagtagagcccgttacaataatagaacctactttgtccgggaatagtgataacgctttttgaacagtaaagatggttcctttaacgttaatgccgaacgttctatcaacctgctcttcagtaatttcacctaatggaaggaagctgccggtgcccgcattagcaaaaagaatgtccaacttacctttttcctgctttatcatgtcatatagtttgtctaagtcttcaagcttagaaatatcaccttgaacaccggttacgttcttgccaatttggttaacagctttatcaagttcgttttgtctacgtcccgtgatataaacatatgcaccttcgtttacaaatttttgtgctgcagcaagaccaatcccacttgttccacccgttacaagcgctattttaccttcaaatttacccatacttaacactcctttagaattaattttattttatgtctagtacctttaagtacttgaagaacaacttacaagatatagtatccttcagtaagcacattatcggaagtacccacttttttgtgatatagtaactaaaaagtaataaatgtggaatggagagctttagacatgaaaaaatttagctgtgggtttgaagtgacaaaggaagttattggcggaaaatggaaaggtcttgtattatactttttaatgaatggaccaaagagaacgagtgaattaaaacgcattatcccaaatataactcagaaaatgctgattcaaacacttagagagcttgaagccagtggacttgtgagcagaaagatgtataatcaagtaccgccgaaggttgaatattcatccactgaacttggagaatctcttaaacctatcttgcaggagctctgtcaatggggaggccattatgcggagcaagagtatgcagaaggtgaatatgaaattgtacagccagaacaactaagttaggattgatgtagctgctgaagtaaatgctaaacaacttcaataccatcacctgacagatgaagaacagtcagaaataaatgagatattcaattttgaaagtgaagttctaataagaagtgtcatggactatattcaggagaactttgatgaaattcaaaaaagagctgtttcaaatgttaaagagaaggttcagaaacttagcaaaaagataaatgaagacatcagtaataacatttaatgcctatatggtctcttcgcatgcattttttacacaaaaagacccggattttaattccaggtcacacttcaggtcacaatttgctcaaattccctcttgcatttctcgaactgctttattcaagatcataaaatttcaaacgaaaccttacacgaaggaatcggggatcggcaaaacaaagccagatataacatatattaaaaaatctcttgcatttccacacccggcatgctatattcatatagcgatgagctgaattgtgtaagccgatgcacatgcccttgcggcacacacgaatgtggcgtgtggtgtatcgcctcaatacgcaaaagacgtttgcttctgcaaacgtctttttttattatccgattttcgttccgttcggtactgtctgctctggcgtaagcaggacaacgtctcctttttccgggatgccgccgagaacgagaacttctgacttaaatccggcgatccgccgcggcggaaagttgacaatagcggtaacctgcctgcccgtcagatcatccggttcgtaccgttttgtaatctgggcgcttgattgtttcatgccgatctcttcgccgaaatctattgtcatcttaatagccggcacctttgcttccgggaatacttccgcttttacgaccgttcctattctgagatcgagcttgataaaatcttcgatgactgccatatcaaaaactccttttttacaatcatgatatcaaaaaaagacgcagtttatttaaccgattttcaggattatttatcagattgaaaggtgtttcggaagacgcgcggcgttattcccttatgtctgacaaaccatctggtaaaggaagacaaattttgaaagccgacctcctgactgatgtctgtcagccggcattttgtttcaataagcatttgttccgctttcttcatacggagctcagcaatataagcttgcgggcttttccccgtctgctttttaaaccagtcggaataatacgccgggtggtaatgttccattgcggcaagctctttaattgaaaaagtctttgagagatttcggcggatatacgcaattgaatcattcgtacggttttcttgtatcttttcagcaatatattctgcaagcagactcaatgaatgagccgactgctgctttgtctcttctgtcagcagaaaccgaatcgatgtccaaaaaggatcaagcttattcagtacgccggggtcaaatgaacctttgaaaaaatatgccggtatgtcgagaacaagacattcatttcgctccaaagaacggaaccgatgttcatgcccgggcggaatatacagcatttgatcaggttttaatctgatttcacgtctttctgtctccaagtccagctgtccttcgagcggaaagagcatttggcagtatgtgtgtgcatgagaatcaaaaatatgcgaataggtgcgccgctcacagatgatatgttgtaatgaatccatttgtccctccttttacatgatgcgttttttatttagtttacataataatattattgtcccctcatctgtaaacctcttaggaaagcaacaactgcaaacttccggctttctttaattgattcggttaattcaaatgcactctgttttctcaacacggcaaatccgtgaagaagactcctcagtcctctcgcagcatgaatcgcagtgtcagactgtgcataaccgttagctgtcagctgcctgacaacaagctctacaagcaggcttgacagattctcaatccggccgtcttttatcttttgaaatgttgcgtcatataatccgggattggcttcggcgaaattgatataggcatcggcaagagcgagcaaagccgtttcacccgtcagtccttctgcagaggccgccattttttcatataacatagttaaaccggagacagccagctctgttttaattccttgaaggccattgacaaaattgtaaagggaaggcggttttacgtttaaggactttgcaacggccgcaagcgtcacttcgttcagccctttttcgtcagcgatacctgctgcggctctcaatatcatgtcaaggctcattccgactctcggtgacattatgatcggcctcccggcaggcttcgttcagcttcctcagcagcctcagccatcatttcaacgggattgcagagaacatttccatgtccggcggccagactgcttggttgatgagcgataagcgttcttgctgtttttacagcttcttctttattccacgtagcaaaagccggaaacggaaatttccatttcagcttccctgaaacagcaaggccgccccgtacttgaaaggcatctccgacgatcagcatatcatttctcatatctttaaaagcgaggcttcccggcgtatgaccgggagcgggaatgacaagtaaagatccgatccgctcgccgcctttcagcaggcgatcaggttcggtctgaacatttttcggcactccccctttatcggcgtttgtgcttcatgctcaaataaagaagtgtcacctttcagcaagaaagaatcccgctcagaaatacagacggaagcatccggaaattccgcagctaatgagtcaagcgaaccgatgtggtccccgtgcgcgtgggtgagtaatatgtcattcagcggcttcccaagctgccgcaatgcttgtttgattcctttatgactgttaggcagtccggcgtcaatcagggttactccttcttcttcttcaaccaaataacaattcaccgggaaaagcgctggaaaaaaagtcagctgccaaacccttccgtattgtaagattctcatcaacatccccctaaaactaataccattagttttattataactaatgctgttagtttatcaagcgtttctgtctaaatcctgaaaaaggcgcgggcgcttctctcatgccaaaaaaagaaacgcgcatactgtgataaaagatgctttcagcctgcgaataaatcagactactaaaaccagccggataagcatacactactcaacggagggggagttccacatcatgcatatcacacttcaaagcatctgccctgtcttaatgattgccttttttctgtataaaaaggtgaaacggtccgtcggctttcagcctttgaaaccccgctggctttacacaagaatgattttattttcattgctggccgccgctctggcgtttttcagcatcacacacccggctttatacgggtatcttatattcggcactttttgcggctggcttctggtcctgtttgccaaacggaacatttcttttgaagaacgccgcggaaaaatgtattttcgcactcacctgtggattgaacttattctattaacgttattcctatcgagatttatttatcgcgttattgaaatataccgggtcacagcggactttacccatccggaggcatacagccaaacggtcggggccgatccgctgaccatcagtatcttttatttcatcgcagtttattacagcggcttctctttttatgttttaaaaacgagcagagaccaaaccaataacagtcagtacggctgacatccctgtctaaaaagcagggatgttttttaatcgtgccgcgtatggtgaatcatttgctgaagcacatctaacacatgttcatcctcaggtgaataatagatggatgttccttctctgcgtgatttgacgaggcgcagatttttaagaaaacgcagctgatgagaaacggtagactgcagcaaattcagcttttctgcgatatcatttaccgcatgttcaccctgtgacagcaaatggagaattctgattctggtcggatcagacagcgccttaaaagtctgggcaaccaaaaataaagtttcctcatctaaatcgacagcggggtcattcgtgtttccggattcgtgaaattcagtcatatacctcacccttcttttctcaagtagcccaattataccaaatgtcatttgatgcagatacatcctgcgcctgacaaaagaaccgttattttaaatttatgtttcaaatacgggtttccgcttggtttcgcgcattcatctgtgtcataatgaaaaagtcataatgctcctgaaattgagggtgaaacacagtggagaaaaagaaaaaaggctgtttcgctgccgcgggtcttatgatgatatgtgtttttgtcatggtttccttcttcctcattctgttattttcaaataatgaatggctcaaaagtcttccgtttgatgtcaaaccgatcgtgcttgaacggctgacagattacaaaccgcttgttgaagacgagctggatgaaaaaggactcaccaaatatacatcgcttgtactcggcatgatatatcaggagtcaaaaggaagaggaaatgatcccatgcagtcttcagaatctctgggtttaaagcgaaatgagattaaaaaccctcaaaccagtatcaaacagggaatcaaacaattcactctcatgtaccaaacaggcaagaaaaaaggcgtagacttggatacgattatacaaagctacaacatgggagccggctatattgattttgtggctgaacatggaggatcgcatactgaggaactggcaaaacaatactccgagcagcaggtcaaaaagaatccgaaactttacacttgcggagggaacaaagacaatttccgttatccctactgctatggtgattacacgtacgcagaaaaagtaaaagcaaaaacaaaaaccgttgaacaatccttaaatgtaacaacacttgaaacgcttgaagagtaaaaggcgccctgatgaggcgcctttttcaatcaatagaaaaaagccgcgcagagcacggctttttttaataatacggtgagatcattaagtatacaatgacacccgtcagactgacatacagccagagcggcatcgtccatctcgcgatttttttgtggcgctccacttgcatgctgaatcctctgatcagcgtaaacagcgcaagcggcacgataacggcggaaagacagatgtgcgtaatcaaaataaagaaataaatcccccgaataatgccgtggccgccgaataaagtattctcagctatcgagtggtacacgacatagcagatcaaaaacagcagagtcgtcgtaaacgccgccaaaataaagcgtttatgcgcttgaatatttttttgcttaatcataaagagcgctgccagcaaaaagataaaagtaaagctgttaaaaatggcatttaacatcggcagaatatgaatattggcaatgctgacctgtcccgatttcggcataaaaaacagcaccgcaattaacccgttgatcaaaacggtcaatgtcagcacgataccggtataacttttaggtttgttttctgtctgattcatcttatgacctctctcaattttactgactatccaaatggtatgagaattcagctttgatgtcaacggtttcgtccgcttcgtcagaaattagacaaacttaagccctaaaaagaccgggtgtttgagacccggcctttcgtcatattatgcttccttcaacagttcttctatcaccttatgttcattttcattcaacagattttttggaatgatccgatctatcggtttattcatatgctgatcgagaatatcggctgtttctttgtcccctgcgattacgagacgctcccattggtgtgaagcagccttttgatctaggtttgaagccaatcgtttatacagcctgttttggttttcttcgacatgggctttggcggcgtcttcctccatcgatgcggagcttccgcttacatcctgcggtttccacgattcattgatgacgtcgtattgataatgctccaccccttcaatttttccgagtacggtttctatgatcttcacttcattctgctgggtgagaataaaagccgtgctcggaaattgttcacggagaagttctaattgatcaaggacagccgtttcttcccaataaaatcgtatttcgacaggcacctgcaattcaatcgtctcccagatgccgccttctcccgatgcaaaaaatacgagacttcgcggcatctctttaccaagcccatcgatatattgatagacgcgttccatgatgcggacgagagatttttcttcttccggatcacttacagacagatactcttttaatctccgaaaaccggttttcaaggcgattttccactctcccccctgctgatccggatttctcatatccgtatttacatataaggaaagcattttatcaggagattccgtcattacgtacttcaatttgccgatgagtgagtcaattgccattatagattcctcctttttccgctgctcactgttcctttccctatccgcaccgccttaaaaacgtcaatccacatataaacggcagacttttctaaaaaagtttttgcaaaacccatttacaaaccaagacatcatttactacaatggatacttgtgtttgactaagacttttacgctgtgaaaggagtatgattttgtttactgcagaagaaagagatcagaaagagctggaaaaagagcttcataaacttgaatttcagattttcagaatgcgggaaaatctgatagatgtatcaaaagacgcgcgagtgcttggtattgatcaatcgaacaatgacgattggatcattgtttcctcgattgatgatggccaaacatgtaagattatgctgactgattgtgaatcagcctaccggggaagaggctgtttttcactgatcgcctcttattatgataatgccattcatatcggggacattaaagggccgccgaaccacggctacggctcgatctgcatgaaatttttaaaacatatcgccagagagcagaatatcccgaaagtgacgggcgacatcgctaagcgtgattgggatcatgtcgaccggctcgttcatttttatgaaaaacatcaatttgatgtctggattgacaatgatacgcaatcaggcggcattaaatgggtcgacctgtaaaaaatgatagataaaccctcgttaatatggtgtaatagattaaaccatttaaggagggtttttttgtatccggaaaaattgaaaaaaggcgacggcattcgtattgtgtctccggccacaagcatgtccgctatgtcagatgaaaatataaatgccgcgaagacaaaattggaggagctgggcttttgtgtctctttttcagagaatgcaaaagaaataaatgaatttcattcatcatcgattgaatcgcgtgtacgggatctgcacgaagctttcgctgatcctgacatcaaagcgattttgacgacactcggcgggttccaatcaaatcagctgctccgctatcttgattatgaaaacatcaagcggcatccgaaaatcctttgcggctattcagatattaccgccctcggccatgccatatatcaaaaaaccggccttattacatattccggtccccatttttcttcatttgccatgaaaaaagggctggactatacgattgactctttcttggcctgctgtgcttctgacaacccgtatgaggtaaaaccttcatccgagtggagtgatgataaatggtatttgaaccaggaggacagacgtttttatcggaatccgggaccgctcgttattcaacccggatatgcggaaggaacactgatcggaggaaatctatgcacgctgaatcttctgcagggcacggaatactttccggagatggaacaagtgattctgtttatagaagatgatcatatgtcggacattcatatgtttgaccgggatttgcagtcactcatccatcttcccgctttttcagccgtgaagggaattgtcatcggacgtttccagcatgcttcaaatgtgtctgaggaggctctgcgtaccgtcatccgtacaaaagaagaactgtcatccatgcctgttatcgcaaatgctgatttcggccatacctcccctttgatgacattcccgatcggaggaacatgcaggatagaagccggctcagaaggcggacggatatggattgatcggcattaatacataaagacgggaaaaccgccccgtctttttattttgacgccttatgccgcggcgtgcgcggagcgatcataattcgtccgccagccgctgccgtcacccatacggaagctccttcataaaaacggctgatctcttcattatatacggcgtgtgtcagttcacgtttatcattcgttccgtcttggttttttacgtttaaaataagtacaagctcgtgcctgccattcttcatcacgccagtacttctcaccttttcaataacggctggccttcctctccctctgtcaagcgcctgaaacagcctgacagcaggcatagacagtccgataacgagcacaatgacgaaagcggtgcatatacctgcttgaaacactggtgattctgtgaaggcattccataaacatatacattccggctccatcagattcatcatcccttcagattccgttttcacatccattccttattatattagagaaacgctttttctttttccgcatataacgattatatacagtcaaaaaagggaagaaaaaaagaacacaaagcatttcgccttgtgttcttcatctctatatgaaactagtctaatactttaacatttacagttctgacgccccagttgttagcgtcacttttctttgcaacaaatacgtcaattttatttcctttaattgcgccgcctgtatctgctgctgttgccactccgtaaccttcaacataaaccttagagccaagcggaatgacactagggtctaccgcgatgacttttgcatcagggtttttgtttaagtcaacaccggttgccgttacaccggaaatgccgccgtcgttagcagagtaagcagttgcagtcattgtcagctgctttttaggctcttgttggtttgtatttgattgaacaggctgctgttttgcttcgacagccttcgcttcttgtttaggttgttgttgttcttgaacaggttcttgtttaggctgctcgtttttgacagcttcctgtttcggctgttctgtctcagcagctggtttttgttcagtttgcggctggctggcttcttgagccggctgtgcagcctgagcctgacctttcacatttaacgttgtgcctgcgtaaattatatctgattgcaagttattcaagcttttcagattgccgactgatgttccgaatttctgagcaattttccagaggctgtcgccctgcttcactgtgtactgcccagatgtggttgtttctactgaagaaatagtcagtttctctccttcaataattaaatcagaagataactgattccattcttttaagtcctttaggttcactccgtttttttgcgagatcccccagagcgtgtcacccttttgcaccgtgatttctttagcagaagcgtgagctccaaatgcagttgttgaaattgctgcaactgcgacaaaggacataatcgtcttcttcataagtaaatcctcccttgttagctttttattggcggctaacaggtgatatcgtaacatatgaaaatgtcagttcaataacaaaacgatttgaattagattacagttcctttacatgaaacatttctctcgcttggtaagtcttgctgaaaccttgatacagcaagggttttcaagcttctgatttttccggcgccaatgaaaaacacaatgtgcaaatttctaaaaaaactttttttcactctgtttctcttacataatttcggatttcttctaaaaaaaccgctccgtatttcaatcttttttgttccccgaccccttttacggaaagaagatcctgatctgttttcggaagtttcgccgacatttcttttaacgtctgatctgagaacacgacaaatggaggcacaccctgttcagctgcaatctctttgcggagacgccggagaagctcaaataattcgtcattttcggtaactgcggcggcctgtaaggcttcttttctcgcgactgcgctttttccaagcagaacgtccctgcctttttgggtgaccataagcgtcggaaatgtgccgtccgccattctgatatattcatctgaaataaggaattcgataaaatcactgatttccgctgcggattgatgcttcataatgccgtaagtggacagactgctgaagccgttttccagcacttttttatttttagacccgctaagcacctgcgccaccatcgtttttccgaagcgctcattcattctgatgatgcatgacaataccatctgcgcttcttttgtgacgtcatgggcggtccttgtatcagtgcaattgccgcatgcttcgcaagcttccgcctcattctcgccgaaatacttcagaataaaccgctgcaggcaatcttccgtatgacagtaatccaccatctgtctcagttttttgagatcctgcttttgtttttcttctccggcggccgattggtctattaaaaaacgctgcaccataatatcctgcggcgaaaacaagagcacacactcgctgttaaggccgtcgcgcccggcccgtccggcttcctggtaatagctctccatatctttcgggatctgcgcgtgtaaaacaaacctgatgttgctcttatcgattcccattccgaaagcggacgtagctaccatcacttgtatctgatcgttaagaaaccgctcctgctggtcttttctgtcatcatccgccaatccgccgtgataacggccggcattgatgccgctgcgttttaatttctcatataaacggtcggtttcttttcttgtcgctgtatatataatgccggcttcgtgtttatttttttcgaggtaccgctcgataaaccggtctttgttttcgccctttactactttaaacgttaaattctctctggcaaaaccggtatatacagtttgttctttcttaatatgaagctgcttacagatgtcatcatgaacctcaggcgtagccgtcgccgttaatgcgatgatgacgggcggttcttttaattcattaaaaaggatttcgatattccggtaactcggcctgaaatcatgtccccattgcgatatacagtgagcttcgtcaatggcgacaagaggaaccgtaatattctgcaggatgtgaatgaattcagaagaagtcaaacgctccggtgtgatgtaaaagagccggtaagccccttgtttcaaaccggtcagacgctcatgaatgtcacggcttgtctgggtgctgttaatataagctgccgcgatacccgcttcttcaagcgcgtccacttgatctttcattaaagaaataagaggggaaataacgattgtggttccttcaaacagcagtgcgggaatctgatagcagattgattttccgccccccgtcggcataatgcagaccgtgttttttctctcctctgcaactgattgtatcgcctgcttttggcccgcgcgaagactgtcgtagccaaaataatgcgccagaagggattgggctttatccagcatatgttgtaaaacctcactttgtctttgattctttcattttatcataatgataaagtacgctgctcaagggcaattcaaaataaaaagccatctccgcaagggaaatggctttcgctacgtatgccgtacgcaagtaagaaagttttaaaccaccactcctcaaagtgggtgtttgcagaagcgttcctgtcgtcctctgcaatggaggcatgacattccggcttcgatataaaactccctattacagcttaaaggttaaaacttaattaacaatacgaacaatgtagcttctcttatatcctacaccatcagtcgtattttggcaagagggttaattcttttacagaaaaccttttttctttgtaaaaaatgctttattctatataaaaattgttttttcgacaaaatatcaatatatcaatataagatcagatcgaaagcttccgccagtttcttctataatagaaaaaactctcacaccctgtaggggcgcaagagttatggcaattagaattttgcagccagatctttcgcttcttgcagtcctttttcaatgatcgcttgagcgttatccggtgcagcattatgaccttcaacgacaacagtgtgaagatcttggacaccccagaaaccgagaacggttttcatgaagtttaatgacatttcaagagatgccatcggtccttcagaatatacgccgccgcgcgcgtttaagagcgctacttttttatctcccatcagacctttagggccttcaggcgtgtatgtgaaagtaacccctgcgcgagacaggtaatcaacataagtatgaagcacagcaggcactgtgaagttccaaagcgggaatgcaaacacgactttgtcagctttgacgaattgatttaagtaaatgtcagcagttgacgcttgttttttctcttcgtctgtcatttcaattccttttgaagctttgaatgttccgttaatcatatctcttccgaggtaaggaaggttttctttatgaagatcaagttcgatcacttcatcattcggattgttttctttataagcagccagaaacgcttcgtataattttacggacacgccttcttcagccgtacggtcacttgattttacaaataatacttgagacattctaaattcctcccggtaatcttttaatatttacttacaaatagtatgttactttcttttttatataaagtcaatgattttatttcgattctgagattttttatggaataaaaaaacaggtacatatgaatgtacctgctgctattattgtgaatcctgctcgcgatccaggatttcgtaagtttgtgagcttttttgatcaacggtttctttatttgagaggtctttcacctgctcgtgaaattccctttcatatgacggagcgtctgttttcacatccccttctgtttctcgctgcgcttcgacggtcattctggcgtacggaacggcttcaagtctttcataaggaatttcttttcccgttttctcacaaatcccgtatgttcctttatccattcgttcaagcgcggcgttcacctcatctaaaagattctgatcgacaccgtccagcgtctgattcgtgaccctgtccaaataaatgcttccgtgatccgctaagtgattatctactccgttcgacaattctcctgtgtcttcgctcattgaatgattttcttttgattctccctgaagactttcctttaaatcgattaatttatgataaaggctgtcctgctgttcttttgataatgacatattcatcatctcctttttcgtctgtattcttcgctgcatctgttaatacataccctcgaaaaaggaggatgaaacaatgggggtcaatgctttctccccctgatggtgacattgggtgtctgctgctttgtctgtcttttttctttcgcagcatcattttgcgggttgtcccgactttcttcagcgcaggcttgtttgagcctgtgcgccggtgtatggtaagtggcgccgatattcagcataccgctcagctcttctatactcagctgttcaaaatcaatattgtattcaaccttgtccactttgacgtgctcaatatggacatatgctttttccccttcaaccgtttgcggctcaaaatgacacttatcctgaaggtcatcaagctgttgttccactttcttaagccggtctaattcttcttcacacacttttttgaaaatctctttcattatttttttcaaagaaaatcacttctttccccgtcactcttggaaagttctatgcgtcccgcattgcgaatatataaacatgatatacaaaaaggaggcgaatcatgatgttttttccatccgttatcaactttgagtatataaaaatgaacggaatcagcggcggagcggcttttaacaccggctcttccattatggtgagaaacacagccgccaataaaagaaatgaagggtacggtgaacaaaacggtgattgcaccgttgtcgtcatccctatcatgagtatcgatgattcagatctgatagatggcacagcgaacaagatcagccttcgataatgatctggcttgcatcccccagatgtttagcaatcgatatatataaaatcccgtctttgaataccgcctgcattcccttcgtaccttgagcggaatgcggaagatcgagttttttttcaaaatcgccgtattttccggtcttctgtttaaaatcctgttcattgaaaaaggattttctcgtgccttttacgacaatatattctccataggacaaaagctgaacatcttgtttccggtagccgggcagatacagcaaaaattggagctcatcatgggtttccacaatatctataagaggaaaagcatcctcatttcttctcatttgcccatctccctgttgaaagggaaaatgagaatggccgttttgaaatgatttcagttgttcatcatcaaaaacgtttttccaaaagtcgccgccggacatgttttgcgccatttccatccattgcttcatcttatcgaaatccatttttatcgccccctgtctaagcatacggtcataacagccggcatacacctgtattaaaggaggtttgcctgtggttcaaccaactccatatatcaatattaatattttcatgttgaaaattaattcctttgaaaatgcttcagcggtgaatgtcggacaaaatttactggcggaatggcagaattctgataaaaagaatcagggatacggacagaacttcggagatgcaagcggcttcatcggcacgaacggcaaagtggatgaccgggatcaaattgattctccatcaacctttgagtctgcatgcgacaaaatccctgccggaaaaggaggcccattatgatgttttcgccggttttggtaaatgtaggaggctttaaagtaaatgcggtcgaccgcggttcttccattacgatcggcccgtatcagcaaatcgattattttttatccaataagatcaactacggattcggtgaagaaaatggtgatttggcgccgatttatatccccatcagttctatcgctgacccggatctcattgattcgaactccggaaaaacaagcattatataataaaaaggccatccgcatgcattcggatggcttttatgtgatatttaactgcataagtattttgttaagatggcttgaacctcagtcaagtccgtttcttttgcaaattccaattcgaaagtttttccccttgtcattaatacaagcccggtatcgggatcaaacattcccgcttcttgaatggcgaagctttcaattgttttatatggaagaaatacgcgcactttctttttggagaacattttattatcaaagaaaatcactcgtttattcgtaaagcatatttggtcaacccgcagtttataaatcgtttcgatccgttctccctcaacgagcaaagcctccagcttttttgtgtcggttgatctgctgacagaaaaaattcccaatgaagaaccccactttctgcttctatactattgttttattacaatcataaaaaataagttctttatccctatataagaatacgacatagacggcatttaaaccattacgaacagattacatttttagaacgttcatcaaaaaagcccttcgcgaaaggtgccgctgttatgaagtaatacggttcagcggaagaaaaggtttcaagaaaacggtatttttttcgaaaagtcagttttttattttcgccataaaaaaccgcagcttctccaatgccgcggtttcaacaaaacatcaacgatccgtatcttcaattgttccttctttataggtatctgaaatttgttccatcgtcgtgtcggtgccttcttcaggttgcacttgctgaagctgatctgatgttttattttgtttgtcttgctctgtttttttcattttgcagccaccctttatatgtagtcttttttagtatggctcaggcaaaataaattcattcagctttaaacttcttcaaaatactctttgtagaagcctccgactttgtttgtattgtctgcaacaaaaatgaattcttctgtttcatttttgacttcatactctttacccggcgtcagcacatttttgacaatgtattttttcgcatctgtatgtacgcatttgacctttttgacgctttcttttgtctgccaattattatgaatcatttataaaactccttttcttaatcgataagcttattgtagccgttttttcttgtgaattgcaataacggttatcgattgattttactgggggtgttattatagaatgactgtatgcgcttactttgcgcggacatcaagatgctcaaaacagaccataaaaaatttcgggaggtttgttacgaatgagttctttaacgatgcagatcacaaaaaggctggaaacatttttacagggtacgaagaaactttatattgacggaaaatttgttccgagcgcttcaggatcaacatttgtcacaccgaatccggcaaccggagaaacgctgatgacgctttacgaggcacagacagaagacattgacagtgcagtgaaagcggcacgcaaagcctttgatcacggcgaatggcgcactatgccggccgcttccagaagcaggctgatgtataagcttgccgatttaatggaagagcacaaaacggaactcgcgcagcttgaaacacttgataacggaaaaccgattaatgaaacgacgaatggggatatcccgctcgcaattgagcatatgcgttattatgccgggtggtctacaaagataaccggacaaacaattccggtcgccggctcatattttaattacacccgccatgatcctgtcggcgtcgtggggcagatcatcccttggaactttccgctccttatggcgatgtggaaaatgggcgccgcccttgccacaggctgcacaatcgttttgaaaccggcggagcagacaccgctgaccgccctctatttagcggaattaatagatcaggcgggcttccctgacggcgtcatcaatattgtcccagggttcggcgagacggccggggaagcgctgaccaaccatgacgatgtcgataaactcgcttttaccggttctacagaaatcggcaaaaaaatcatggaaaaagccgcaaaaaaaattaaacgcgtgacactggagcttggcggaaagtcacctaacatcattttgcctgatgccaatttgaagaaagccattcccggcgctttaaacggggtcatgtttaatcagggacaggtatgctgcgcaggctcccgtgtcttcattcacaaagacaaatatgatgaggtcgtcagcgaaatggtttcatatgcgaaatcgcttcagcaaggcgccggccttcaccaagatacacaaatcggcccgctcgtcagccaggaacagcatgagcgcgtgctttcatatattgaaaaaggaaaagcggaaggagccaaagctgtcgcgggcggcagctgcccgtttgaagaagggtattttgtctccccgactgtatttgcggatgtggatgacagcatgaccatcgcaaaagaagaaattttcggcccggtcttagccgccattccgtatgatacggttgatgaagtcattgagcgggcgaaccgctcggaatacggccttgcagccggactttggactgaaaatgtgaaaaacgcccattacattgctgaccgtctccaagccggcaccgtttgggtcaactgctacaatgttttcgatgcggcatctcctttcggcggctataagcaatccggcctcgggcgggaaatgggctcttacgcgctgaataattatacagaagtgaaaagcgtctggatcaacctggaagattgatccaacaagaaactgctgcctgtcagcagtttctttcttttgtcatgccgtcttttacatatgaatatatatgcttctgaaggagttgagcgagtgtgagcacaattcatgaaaacgtcagaagccgccaaaagaaaaccatctccctattaagagaaacgcaaaatgcggacggctcatggtcattttgttttgaaggaccgattttgacaaacgcctttctgatcctccttctcacttctcttggagacaatgataaagaactgatcgctgagcttgcagaaggcattcgcgctaaacagcgcccggacggaacttttgccaactatcctgatgaccggaaaggaaatgtgaccgctactgtacagggctatgccggcttgctggcttccggtttatatagccgttctgaggcgcatatgattcaggccgaacgctttatcatctcaaatggcggcttgcgcaacgtacacttcatgacaaagtggatgcttgcggcaaacggcctatatccatggcccgcgctgcatctgccattatctttcttagtcattcccccatccttcccgctgcatttttaccagttcagtacatacgctcgtattcattttgtaccgatggccgtgacgcttaacaaaagattttcgctgaaaaatcccaacgttccgtctctcgcgcatttagatcggcatatgactaaaaatccgtttacatggcttcgttccgatcaggatgagaacagagatctctcttctcttttcgcgcactggaagcggcttttgcagattccagccgcttttcaccagctcggtctgcgtacggccaaaacgtatatgcttgaccggattgaagaagacggcacattatacagctatgcgagtgccactatttttatggtgtacggcctgctcgctctcggtgtatcgcgccactcccccgttatcagaaaagcgcttgccggcacgaaagctttgctcacgtcttgcggcgatataccgtacctggaaaactcaacgtcgaccgtttgggatacggcgcttctcagctatgcgcttatgaaaagcggcatctcagataacgatcaaatgataaccggcgccgcccggtttctgcgtgaacggcagcagacgaaagtcgctgattgggccgttcacaacccgcatgctgaaccgggaggatggggtttttcaaacattaatacaaataatcctgattgtgatgacacagccgcagtgctcaaagccattccgcgaaaacgttatcccgcctcatgggaacgcggactgagctggcttttgtccatgcaaaacagtgacggcggcttctctgcttttgagaaaaatgtcaatcatccgctggtccgcctgctgccgctggaatcggctgaggaagctgccatcgatccttcaacaagcgacttaaccggacgggtgctgcactgtttaggagaagcggggctttcttctgatcaccctcagattgaaaaggccgtccaatggctgatccgccatcaagaagaggacggatcgtggtacggcagatggggtgtctgctatatttacggcacatgggcagcgctgacagggatgaaggcttgcggcgtgagccaaaaccacccggccgtgaaaaaagcgatccgctggctgaagtccattcaaaacgaggacggaagctggggagaatcctgtaaaagcgcagaagtcaaaacctatgttccgctttcttacgggacgcttgtacagacggcttgggcggccgaagctttgctgcaatacgaaaaacctcatcatcaagccgtcacaaaaggcatatcctttcttattgaaaaccggcattacgaaggagacgctttcagctatccgaccggaatcggcctgccgaaacagttttacatcaagtatcacagctacccgtatgtgttttctttgcttgcgctcagcacttttatgaaagtgagtgaaaaggaggaagaaaaatgaaacggcacgcttatcaaaccgaaatgctgaattggtgtgaaaccttgaaggaacaagtcatacagcaaggtcggttcgatcgcttcgcggcacaaatcgaccggatttttcacacccttcaggatgatggattaacggaggcggaatggtacgaacaggcatcagcactttaccgggacattaccgaaccggatgagccggatgagcgcagagcctatgtgccgatcggcaagcatgtcctccctaaactgccatacagttattccgcactggaaccgtatatttcaagagagattatgaaactccatcatacaaaacaccatcagagctatgttgacggtctgaataaagcagaactggagctcaaaaaagcgagacaaacgaaacagtacgacttagtggcgcattgggagcggcaattggcgtttcacggggccggccattatttgcacagtattttctggttttccatgaatccaaacggaaaaagacggccgacgggtgcgctctttcaaatgattgatgtgtcattcggaagctattctgcttttaaagagcaattttctcaagcggcgaaaaaagtcgaaggagtcggctgggctatcctagtctgggcgccgcgcgccgggcggctggagattttggccgctgagaagcatcagctctacagccagtgggacgtcattcctttgcttccgctggatgtgtgggaacacgcttattatttacaatataaaaacgaccgtgcggcttacgtggatcaatggtggaatgtcgttgattggcgggaggcggagaaacggttcgaacaagcgcaccgcgtgatatggccgctttattaaaaaagcccccgtcttgaacggggggcctgcttcttttggtctaaaaaataccaagcacgtgcagaaaaacgataataatggctacaggagccacataacggattaataggagccagactgcaaaccattttcgttttataccggaaccgcttttcagttcgtcaaacagcatctgtttcgaaattttcagcggtacgaaaacggcaattaaaagcgcgcccagcggcattaagacattgctgaccagaaaatccgcagcgtcaaaaatactgcggtgaaaaatagaaacatcactcaaaattccgtacgacagcgccgaaggaaccccgacaataaatatagcaagtcccccgatccatgcataccgcttccgttttgccgaatcgccttttgacaaaacagcaactaaaatttcaagcattgaaaaagccgatgtcagcgtcgcaaataaaaacagcagcaaaaaggcgagtaaaaacacgatgcccaacggcatttggttaaagactgtcggcagcacgttaaataaaagctgcggaccttgatccggcttgaggccgaatgcaaataccgccggaaaaatcgccactcccgccatcacggcaacaaggacatttaataccgtcaccgatacggcggattgaacaatattttcttctttttctaaatatgcgctgtatgtaaccattacggacactccgacgcttaacgagaaaaatgattgtcccatcgcatataaaatggtattggcatccatcgcgccaaaatcaggcatgaagaagaattttaatcccttcgctgcatcatgcagcgtaacggaacggatcattaaaagaataaacagaataaacagagccggcatcagcacctggcttaccttttcgatgccgctgctcaccccttttgccacaactaaaatcgtcagcacgataaacagcagctgaccgaaaaccgctgcataagggttggaaatggtatcgataaataacgtatcaaatcccgaagaaagcgataaaccgcctgtaaagccttttataatgtagattaatatccatccccccactacgctgtagaaggacaatagaataaaacacgtaatgattccgagatatccgatccagtgccactttttccccggcgccagcgccttataggattcaacggcgtttttttgtgtttttctgccgataataaattcagcaagcaaaagcggcagtccgattaaaacagtaaataaaataaaaacaagcagaaaagcgccgcctccgctggttcccgctacgtaagggaacttccatattgcgccgagcccgattgcagagccggccgtagctaaaataaatcccagcttagatgaccattgattagcttctttcacttcagcactcccaattcatttcagtataaaaatcaattgtaagaatatatgtctgaatagtcaagaagatattagtttacataataattttatcgaaaacttatatttaatattgaattattcagaatattatttataatggagtacagaaaagtcagtcatattttctgactgattgattggatataaaaggagctgtgtttatggaatggctgaaaaaaataagcgggtttgcgggccaaacctttggcttgtgggttatcgtctttgccggtttgggattcgcctgccctgatttgtttacttggatcagttcttatatgacgattttccttggtattattatgtttgggatggggcttactcttcaagcagacgattttaaagaattaatcagaaagccttggcttgtcgtgatcggggtcgctgcccagtttacgattatgccgcttacggctttctgtttatcaatcgggctccgcctccccgcagaaatcgccgcgggcgtcattctggtcggatgctgtccgggcggtacggcatcaaatgtcatgacgtttttggcgaaaggcaatacggcactttctgttgcggtcaccacgatctcaacattgcttgctcctattgtaacgccggcacttattatgctgtttgcgaaagagtggcttcccgtttctttcggttcactgtttgtttccattatgcaagccgtgcttttgccgatcgtcctcggggtgattgtgaagctgttcttcaaaaaacaggtcggacaagccgtgcacgcgcttcctctcgtatcggtaatcggcatcgtagcgattgtatcctctgtcgtcagtgtaaatcgtgagcatctgcttcaatccggactgctgattgtgtctgtcgtcatcttacataacggaatcggatatttgttaggattcctgactgcaaagctgttcagaatggattatgcttcacaaaaagcgattgcgatagaagtcgggatgcaaaactccggactgggcgcagcgcttgcgacagcgcatttctcccctttgtcagccgtgccgagcgcaattttcagcatatggcacaatctgtcggggtctgttcttgccacctactggtctaagaaaaaagagaaaaacagcgccgaagaagaaacggcaaagattccgttttcataactgaacaaggataggctgctgcagctcctatccttgtttattctgcagatcacgaaacaggcgcaaaagcgctttttttacatccccctgaaataaacctccatgataacaaatcaattggcggatatcgtaatcgagcagccgctgcacagaacggaccgcatcatccatatgtaacgtatagccaggattagcaaggttcagctttccgtcttcaatgacgaccgcatcacctgtgatcattgttttttcggcaggcagataaagactgatatggccgggtgtatgacccggcgtggctacaacgcgaatgcctccgcaccaaggcagcagctcaccgtcagtaactgtccggtgaactggagccgattcgactgattgaagcgagcggatgaactgttttgcataaggctttgcatcctctggcaatgaactaaacgttgattcagcctgctcaagccgtaaagattttttagagccgtcaatatacggcgcttcacgctcatgtactgtcacgctgatatccgggtgcaaacggtgtaatgcagcgagtgagccgatatgatctatatcgtgatgcgttacaatgatttttgtcaatgaatgaagcgacattccatgccgggcagcagcatgttgaagatggtttgtaaaaccgggatatccgcagtctattaatatcgtgtcatgttcgtcttgcagaagaaccggagtgattgaatgcaattcttcattatattcaaattcgatctcaagcggataacagcttttcatataaattctccccttcgctcaataaaaaaagtacactgcttgtaagggcagtgtactttttgtctgtctcaaattatccttccagcagcagctgttccggatcttcaagcaggtttttaatggtgacaaggaacccgaccgcttctttaccatctacaattctgtgatcatatgataaagcgatgtacatcatcggacggttttcagagcgctccgcatcaattgctactgggcgcagctgaattttgtgcatacctaagatcccaacctgagggctgtttaggatcggtgttgacataagcgatccgaatgtacctccgtttgtgatcgtgaaggagcctccttgcagctcacctaatgttaatttattgtttcgcgctttcttcgcaagttcgccgatctctctttcaatgccggcaaacgtcaggcggtcagcgtcacgcacgactgggacgacaagcccttcttcagccgcgacagcgataccgatgtcatagaattttttcacgatcagctcatcgccttgaatttcagcgttaaggagcgggaattttttcaaagcagccacgacggcttttgtaaagaacgacatgaaaccgagttttacatcgttttgctcaaggaattggtctttacggcgttttcttagattcataacagccgtcatatcaacttcgttaaatgttgtcagcatcgcagaagtctgctgcacttcaaccaatcgtttcgcgatcgtctgtctgcggcgggacattttttgcacttcaacaggtttgtcaaagctttgctgtgttttttgagcctgctgtttcggctgtgccgcaggttttgaagccggtttttcataagcttccacatcttgtttgcgcacgcggccaagcgggtcccccgtcggaatttgtgatagatcaattcctttttcccttgccagcttgcgtgcagccggagacgctaccgttttggatttcgcttctgattgtgcttcctggctgacttcttgtgcagcaggttcagcttttgcttcctctttcgtttgttcattggctggagcactttctgaaggggcgggtgcagaactttcgccagcgccttctgtaatggtaccgataatttctcctacttggacggtatcacccgaatctttcaatacctcttttagaacacccgattcttctgctgtcaattcaacatttactttgtccgtctccagttcaagcaagtactcaccctgttctacataatcaccgggctgctttaaccattgggctatcgttccttctgagattgattctgctaattcaggtaccttaatttccgccatttttacatttcccccttagtttttgcgagtcaagctatcagatacaatgcgttcctgttcttttttgtggactgtcggatctccttctgcgggactggatcgtcttcttcggccgatgtattggacatttactccttttggcgcaatttccgtcagatacgggctgatataactccatgcccccatgttctgcggctcttcctgaacccaaacgatctcttgcaggttcggcagtttggcgaaaagctccttcgtatcttttgccgggaacggatacagctgttcgattctggcaatatgaagccaatccttatcgccttccattttgttgaagtgatcgctgatatcaattgacacttttccgcttgataatacgacgcgagtcactttttcgtaagcatgggaaagaccggactgctcatagacaggcttgaatcggctttcgctcagttcctgcacttcagataccgtattcgggttgcgcagcaggctcttcggcgtcatgatcacaagcgggcggatttcctcacgaagcagcattttcgcttgtcttcttaaaatgtggaaatactgagccgcacttgtcaggttggccactgtccagttgttttccgccgccagctgcaggaaccgctcgacgcggccgctggagtgttcagggccctgcccttcgtaaccgtgaggcagcagcatgaccagccctgatttttgtccccattttgcccgtcctgcagatatgaattgatcaaaatagacttgagccgcattggcaaagtctccgtactgcgcctcccacaacacaagcgtttcaggcgaatacacgttgtatccatattcaaagccgagaaccgatccttcagagagcgggctgttatgcaccgtaaatgaagaagcgcagtcgtctaagtgatggagagcaacaaattcttctcctgtttcgctgtcatgcagcacaaggtttctttgagcgaacgttccgcgctctgaatcctgcccggtcagccggatcggcgtgccgtctttcaaaatggaagcaaacgcaagcgattcagccaatgaccattcaactttacggtcatcatcaaacgcttttgcacgtctttccaggattcttttcagcttgccgaacacgttaaaggattccggccagttgataagttcgccgttcagcttgcggagaacatcaaaatcaatggctgtgtcaacgtctggaaaaccgttggacaccggttccggcaattcaatttcccgtacggcgtcttcttttttggcgggcacctttttataggcgtcttcaattcgttttgtcactgccatttcgatgttttgcgctttttcctcgctgatcagtccttcacttacgagtttttccgcaaagatccgcttgacagtcgggtgttttctgacggcatcatacagcatcggctgtgtcgttgacggctcatccatttcattgtggccgtatcgtctgtacccgatcaaatcgattaagaaatctttattgaaccgcttccggtattcaaccgcaaatttaacggctgacaggcatgcttccggatcatccgcgttgacgtgaacgatcggaatttcatagcccttcgccaaatcactggcatatttcgttgatcgtgattcatcgctttcagtggtaaagccgatcatattattggcgatgatatgaatggccccgccgacctgatagcctttcagagagcttaagttcagcgtctcggcgacaatgccttctcccgggaacgctgcgtcaccgtgaattaaaatggcgagcgattttgtttcatcttgaaccgggtaccccttttgcgttcttgtttcctgtgccgcccgcgtgcttccttcaacaatcggattgatgaattccaagtggctcgggttatttgcaagcgtaatccgcgcgcttttggtttcagcatcctgaagctgtctgtctgcaccgaggtgatattttacatcgcccgtccagccgtagctgatgccggtcgatccttcagatggcacaaggtctttattcggtgcgtgctggaattctgagaaaataatttcatacggtttgccgagcacatgcgcaagcacatttaaacggcctctgtgcgccatcccgatattgacattggttgtgcccgctttcacagactgggcgataatgtcgtcaagaaccggcacaagcgcgtctaatccctcaattgagaaacgcttctgaccgacgaatgtccggtgtaaaaattgttcaaatccttctacttccgtcagtctttctaaaacggctgacagtttttccggtgaatttttccggaacagttctccggattcgaccatttttgtaatccatgcgcgctcttcgaaatcatgcacatggtcaaactcgaaagagatggttcttttataggtattgcgtaaatgctggatggcttctaagccgtttgttatattggcaggtgcgtctttacagatgacagacgcgggtattgctttcatttcttcttctgtaagcccgtactcggataacggaaagagctcgctctttttcggatcctttctgagcggattgacggaagcgttcagatggccataggttcgaatatcttctgcaagtttaactgctgctgcgatcttttgaatcagatctgcggtgacgcgtccctgttcctttgtttccgatgcctcttttatttggcttggcggagcgccgagttcgtcaaacatgtctttcagatccggatcaatgctgtctggatcttcagcatattggtcgtacagctccagtgcgtagccgaggttcggtccgtaaaaatcttcccaattcattctttgtttcatattattttgaaacatttgaatattacccccaacctagataatcaagtgatcaattcactatcttgaaataacttttgaacactgtgcccaaaattatgtaataaaaacgcttccaaggatattttaccactgattgcgtttggattctaccttgattgttcacaaaatagtaaaaaaaacagatcaataccgaaaaaattaaatcattttaaaataaaaagcgaaaaagcataggaaaaagcctatcctatgcttttatgaagcagttttttcaagagcggatacagcacatcgggcagctgatcgacatcgggaacaaaaatactgtactttccgtacatatcctgaatggttttcatctgggattcttctatcgcagtattggacagaaaaacatttatgacttctatccctttttttctcgcttcgatgacagcctcgctcgtatcgacgatgccgttttgttcgtatccgaatgctgccggctctccgtctgaaaacacgattaaaaatttttgcgcctcactccgccgcatcagctgtttcgtcatttgtctgatggcgtatccgtctctgttatcttcttcaggcgcaagctgcatgattagcggacccgcagcctgcagcagcgactcttcaaacggaatgacggtattgaagaaattcggctggctcgtttcggttgcttcgtttgtatcctcccaaaatccgacgatttggtgagggacggacactgatttcaaggcttcatgaaaaagaacgatccctctttttgtttcatccattttgtcaaacatgctggccgaacaatcgacaagcaatgtaaaaacggcgtcaatgtctgaagacgggtcctgctttttatagaaaaggcgcgggttccgttccgtaaaatagcggatcagtttgcgattcagccggcctgcgtgaaggtcggtccgcgggagtgtttttttgtgctcaagtgttttttgtatcatctgcttcaggcgtttttgatatgattctatcgtttttgcctgttctttataagactgctcctcttcaggagacgctttatgaggcgtttgataaaccgggaaggcaaatttgttttcttttccgtcagccagcccggcgccctcatgttcatcctgaatggattcaagcgcttccagtttggagtaatcctctcttttcgtctgacgtgcggaaccttgaacggagccgagcgcctggtcaccgtcatcgccttctctggccgcgtctttcccaagatctgatttcgcgccgtgctcaatatcaaattgaaggaagctttttgacggcgcttcggtttcccggtgccacgtattcattttctcttcaaggatctcttcatctccgtcggaagactcagggagcgtgagatcgtcacttaatgaaggcgctttttttacgctttcgaataaaggctcttcagcagctttttcgtaatcaagttccggcagaaaaaagtatgtgttcagcatatctttctcaagcacttcatcaaggccttccatgaggtcttccgttattgttgcgatttgttcagtagaatccgcctcatacacccggatgagctgacgttcaatatacggtatcatcatatcaatattttcatgcatggaaggaatgccttcaagcggagactcagccgtcagcttgacaaacatcgcgcaatacaaagcgtcggtgaaaatgctccgttctaaattcagtgtcagctgcgtcgtgaaatatttcctgtacatctctctccgcttctgaaaaacacgtttcgttcccggccgttcttttttgatcagctcttcaattctgatatcctcaagcagcataaacagctgcttggcaaagctttggcgggtgaagtgccggtgaacgtcatttaaaaaccccgcaaatacccgaaatgagctgctgcgtgtcccgacagcgcgcaaatagacatcgcttttcaggccggcttccatatccccggctgatcggtcttgccaaaagtggctcatgtaaattttcttttcaaagggattgtagtaagactgcacgccgtattccacttcaacttcactgcttctggtcagtgttttggcaagatcagtcagcatcatgaacaaaaacgaatcaatcgtgctgtcgttaaatttgataaacttcattgtatatccctcattcgaacagcgtttctgcaatatttctgacagcggctttttccctgtcatcgtcaagtttttccacgatgcctctttcaatcgcccgtttcggcgggatgtacgcagccaagtcgcacgtatcaatgagagccctgatggatgccgcttcttctgacacttgtccgttatgcgcttgtgcgattaaatcagaagacagcgtcataaagcgctcaattaatttctcatcttttaagacagactgagaggtcagcacctgtttcaggaggcttcctttaatatacggaacatcaatgattacaaaacggtttttaagggcttcgttcagcggaacggtgccgacgtagccttcattaatcgcggcgataacaccgaatccttcgcttgccttaatcacttctcctgtaaagggatttgtcatcatttttctgtaatcaagcacgccgtttagaatcggaagggtttcaggctttgccatattgatttcgtcaatgtataaaaaatgtccctcgttcattgcggttgttacaggtccgggaacgaattcaattgtcgcctgcccctgttcattttcaatcgttttatagccgacaagcgcttctgcatcgaggtctacggagcagttgacgctgtgcatcggtttatgaaaatagttcgaaagcgtttccgccaattttgttttccccgaacccgtcggtccttttaataagatattttttcccattgtcaaagcgatgacggcatcgaatacaatcgctttatcttcggcctcatagcctgatgatccgattaaatcccggaattcttgggaaacgggatgattttgataagcctgcagtttgttttgtatatcttccggaagtgataggtgctgtaattctgaagtcataggtgatgtttcctttccatttgtattccataaccgagtatactaaaaaagcccttgtatactcaatacaaaagggctcattccctgcgggcgctttttgtcaggggagcgcaggcgattctggctccggaatttccgctcgggtttgttaaataatcgtccgtatgttcatgaatgacgaacgcgcttccgtcccggtcgagcaggctgagtctgctcccttcttttaatgaagtttgcggcgcgttcataatgacatccactttaccgtcagcccccacttcaagattggggagatccccggcgtgatgacccatcggattgttgaagccgtgttctttgttcaaagggttgaacggaccgccggctgattcgaaatcaggtgcctgacatgtccctttttcataaatatgaaatccgagagaagcgccgggcggcagatgtcccgctgatatatgaatgtctgacccttcatcatcagattccctcacttcgatatatccgatcgtttttccgttttgattgatgagtccggcatgctcacggtatgcagatgcttccaatgcgcggctttccccatgttttttgggcggaacaggagcgggtctccccccgcagccgcaaagcgtaattgatgcgagcatgagaaaaagcaagagacgattcatgcttcctcccccttatttttttacccatcagtcttgtcaaaacgtgaaaatggtaaacaaaaaaaagccccgaaaggctttttttaaaaataactgcgcgctcctaaataagcttttttccaatatggattgcttaagtttgaaatttcaaccccggaggagcttgcgtgaataaagtctcctccgcctaaatacattcccatatgagaagggcccgctttatatgtcgtaaagaagacaaagtcgcctgctgacggctggctgatatgtttcatcgtattccaatatccggccgtgctcagacgggaaacagagcttaccttatttaaaaggtaatagatgtaaccgctgcaatcgaagcccgcaggcgtattgcctccccagcggtaaggtacgccgacatgttttttcgcctcgcctatcattctgtcaatctttgaccctgtcaccggaggttcgggagtatttggcttgtttggcttttccggtttgttatccggctgacgcacaggatcttctgtttttcccgttccgttaatcaccagaacctgtccgatttgaagaacatcagttgtcagtttatttttgtctctgatgagctgagcggtgataccgaaccgattagcaattttccagagggaatcgcctgcttttactttgtaagtggatggcttctcagaaggatttgaatgagatggcggtgttgtgccgctgtttccgttatgtgaagaacctttgatctttaatacttgattcggatacagcatgtctgatgttaattgattcagctttttcagttcggcgatggtgatgccggtttgattggcgattttccacagcgagtcacccggcttcacagtgtaagtccctgatgcgcctttatcaggctttgtctgtctgccgcctccgtccgtgccgccggcagaccctttaattttcagtttttggcccggatagatgacatctgaactcaaacggttcaggcttctcagttcagaaacgctcattcggtatttttttgcgatcacccataatgagtctccgtatgtaactgtgtaggcacccgtgcttggttttcccttttgccccgttttatgtgtgccgctgccgtcgggaatgtgcagccgctgtcctgggtggagtatcgttgatttcagtttattttccgcctgcagagctgaaatacttgtatgatatttccgggaaagcttccaaagagagtcgccgctttttacttgaatggtttttgcttcagcgggatgcacggcgaaggttgaagtcattactgcagatacagccagtccggctgcgatttttttcttcatataacgaaaaacctcctatttatcattgctgaaagggacgtcccttttctttggacgccgcctgttatgcaggattcattcagaagtcgacattaattccgattcatttggtcttagatcatcaccaatgccacacattttacataaattgagaacatttcacaaaagactttggaatcattttcataacatggcttttttccgcgacattccacctttcttgtctgtttttcatacaattctctttacggcgtggaaaatcctcccgaaaaacaatcaaaaaaagcccgcttcctttaaaggaagcgggtgacggctgattacagaacccgggtctcggcagttttcacgtcttctgctatcaattccgctgcacgctgtgctccgccggccgctttcagggattctccgatttcagaagcttttgtctgatattcaggattttcgctcaattcttttattgcttcagtgagcagctccgctgttacatcttcttttttaaacatcttgcccgcgcccgtgttttccacttggcttccgacggcgaactgatctgcgcccatcggaatgacgatcatcggagttttgtagtaaagcccttcgctcgtactgttcattccgccgtgagtgataaataagtccgctctcttcaggatctcaagctgcggaacataaggctttacaatgacattctcaggaatttcatcaagctccgccggatcaagatgtttgccgattgacatgacggcttttccgttaaagtttctgaccgcttttaagcatttattaaacaattccttctgattgttaaaaatcgtgcccattgaaataaacaggactttttctccttcaagctggtcaaacgggaaatcctgagccgccggcctttcagttatggacggaccgacaaagagataagaatcgccaaactcttcttctttcggctgaaacgctcttgaagtaaatacgatggtttttctgccgtcatttgagaaaatatcatacggcgttttaatgtctgcgctgaattcttcattgagccggctgaccgcttcggtataagccggataatgagatgattcctctgatacaaggtttgtatttgaaaacacttctttaataaatgcttcattcattgcaaatgtcgtgcaaagtgaatatgccggcagtttcagcttatttctcacaagccttcctgccagaaaatgatgatcatacaggatgtagtcgtaggactcatcttttacttcctcaagaatacggagtgcggctttttcggaagtctcaatcattaatagcaaaaactcggtagcgtcccgctgttcatcaccagttgcgttttttccgaattcatcttttcggaaatcttcatattcacggaattccgctccgcttgacgcgattttgttctcatattccttcacgccgtaatatacgacatgttccccttttgccttcagttcttttacgacgcctaaagacggattgatatggccttctcccggaaagccgatcatcaatacatttgccatctttccactccctattcttttaaattttatgtatatttaaacgataacatcaatacagaaaaaggtaaagatgttcaccttattaatattaaatgggtacaatattcccattttcttattatttcgtatgaagcgcccgcggcgaaacaagcggatacagtccgccgtctttagcaaaggacattttccccgtttcttctgaaacaacgagcacgagtgcatcagtcacggccgaaagtcccatcgcggccctgtggcgcgtcccgtatttgagattgacatgttttgttgtgagcggaagcacattggctgctgatacaacccggttttctctgaccaatacggctccgtcatgaagcggattgccgggataaaaaatactctcaattaaagctgaactgatctcggcatgcaggctggtccctttttgtatcattccgtccagcggatctgcacgttcaatcacaatcagcgctccgtgcttttcttccgccagatgctgcacggccctcgccagctctgtataggaaggcgtaaaatgttcgatatatgactgcaggtaaaacgacgaagcgacagcctgcatttcctgaaacgtatgtcccagttcatctaattcgcaaagaaggcattggtctttttcatccaatgtccgcagtatcattccggcatcctccgtaatttgtttcaaatacgtttgaacggcagcggtaaacgcgctttccgtcatttgagtgtggcgcatgtcacatcatctcctttcccttattttctgcatcgcgcgcatggatatgcgccgctgtgtacaccataatcatgaaaggaggcgcacatcatatggaattcgcacggctgatgcaatatatctgcacctttttaggggtcatttcactttcattcatttatgccaagatgtttaaaaagccgaaaccggacaaaaaagagtaggccggctttcattgctttttatacataaaatgttataatttctctcgttaaaataaagaaacggggaacctaaattgagagaaacgaacacgatcggccaaaaggtcagacagctgttacatatcttcattccgattttaatcacgcaggcgggcctttccctgatcacctttttggatacggtgatgtcagggaaagtgagcgccgccgatttagccggtgttgcaatcggttcaagcctgtggacgccggtgtatacgggccttgcaggaatattaatggccgttacgcccgttgtttcgcagctgtttggagccggcagacgaaaggaagtgccgttttccgtcatccaggccgtttatgtagcggccattctcagtgcggcggttatcctgatcggctttttcaccgttgatatgatcttgggacatttgggcctggaacctcgtgtccggacgatcgccaaacactttttaggctttttatccctcggtatttttcctttgtttgtgtacgccgttttgcgctcgtttattgacgcactcggcaaaacgcgagtcacgatgcttattacgctttgctcattgcctattaattttgttttaaattatgtatttattttcgggaaattcaacatgccggcattgggcggagtcggtgcggggctcgcttccgccctgacttactggtgtatttgcgccatcagcttttttatcgtcttcagatttgagccgtttgccgggtactctgtttttcggaaactgtaccgtttttctccgtctgaatgcagaaaacttttgaaaatcggtttgcctatcggttttgcggtattttttgaaacgagcatttttgcggctgtcacacttctaatgagccatttccggacggtgacaattgcagcccaccaggcggcaatgaattttgcttccctcttgtatatgctgccgctcagcgtatctatggccatgacgattttagtcggctttgaagcaggggcaaagcgctacagggatgcccggtcatacagctatatcggcaatgtgatggccctttgtttttctttatgcacggcggctttcattttactgttcaggccgcaaatcgccggaatgtatacatcagatccggaggtgctcatgttgacgcagcactttttaatctatgcgctgtttttccagctttctgatgccgtagcagctccgatacaaggcgccctgagaggatataaggatgtcaactatacactcggtgcggcttttgtttcgtattggattatcgggcttccgctcggttacgcagtcggcacttacacgagcctcggggcatacggctactggatcgggttaattgcaggacttgccgcaggagctgtcggtttattcttcagactgatgaagctgcaaaagcgttatgtgaaaaaaatgatgattttataaaggaggagcagctatgccaaaacataaactgctgtacgattatttaaccgaacgggcggaggacatcagtcagacatggtttgatacccttcatgatacggatcctgattctgtttatgcttctactgacccggctgttctcacaaatttgaaaaaacaaaatctggcgtttaattatcaactcaatcggattttttctgaagagaaggaagtatatacagcggcattggaaaagtgggcgtttgaagccgcacgggataaagaacatttaaaaactcccatccattacatcattcgcgagtttatcagagttcgtgatttgtatgtcggccatgtaaagcagtttaccagacttcattcagacaccgtgacagaagaagatgccgaagatatattccatacgctgattaaatcgtttgatgtggtcattcatattttcatagaggaaatgtataaaaacacaaacattcagcttgaagcgcaaaaagaattgattaccgagctgagctcgccggtcattgtgctttttgacaatgtcggactgctgcctctgatcggggatattgacacggcaagagccaaaatgattttggagaatacgctgcaccagtgttcagagaagcgcatcacgcagctgtacattgatttatcaggcgtagccatggttgatacgatggttgcccaacagcttttcaccttaattgaatcactcggaatgctcggcgtgaaagcgacattatccggaatccgccctgaaatcgcccaaaccgcggtacagctcggactgagtttttcaaatttatcaatacggtcttcgcttgcggaagcgatcgcttccgatctgacacaaaaaaagggataaggcatttcagccttatccctttttttatcagtctttccacggatatgtccaatacacttcttcttcaaaccatgtctgaagaaccggctcgttatttttaattttttcttccagctctctcagcatgccttccgtttgggtgcggtgcgcttttaaggcattcattttaatatcggcaacctctttaatatcaagaatgacatcaggcttgccgacggcttcctccctgttgcgggtgattgccatgcaaagcgtgcgcgggcggtcctcttttttctttctgtaaagcgctctgatgaccgcttcgccgcatgcatcatgatccggatggacgccgtgctccggatagaatgtgacaatcagactcggttttacatcgtcgataatctcttccatcatatccgcgagccactcgtcatcttcaaattcaagtgttttatcacgaagcccgagcattctcaggtcagtaatgtccattgctttacatgcgtcaatcagctcttgctttcttaacagcggcagtgtttcacggttcgcgaaaaagggatctcccatgttccggcccatttcgccaagcgttgcgcatgcatacgtaacgggaatatttttttgtctgtgtaaagcaatcagtcctgccactccgtatgattcatcatcagggtgaggcaggatgacgagtacatgttctttcatgattttcacccttttctttaaactgtaaacggcttttcgctgatttgaagcgaaatcgccaattttccgcccggcagatgccccgccattaacaaacggtcttcttcatctactgtatactcagtcaaaccttctgcgtaaatccagccctcttctgttttcaaaccgacgcggtacgggccgtttcctttgattttcgcctgatggtacgtcacttttgcattgcgtatataggctacaaccgtcatgtttttctcattcagatgcgctgaataagaaccggtcgttgtttccaaatggatatatacaggacgatcggcatatcgctctaaagaagtttgcacatcttcttttatgatcgctttcatagctgctcccctctttcttcttttaaaaattgcaaacgcttcgtatgtagttcaaccaattcatatttctcaatcggccgcagccgggaatctacaattcgctgcaccgccagagcaaacttttcctcgggtgacttccggagcctcggatgtgttctttgatcaagcagttcaagatcaatcgccttctccgcttcttcaagggttgaagccgggagagtgcggttattccacagtgcctgataggcttttgctatgtctttatcagtgcccattgtacagctcctttacatactcgtaatgattatacataatttaagctatcgctggaaagcgaaaggcttagcggctttttatcggccgcttccattttatctgtgaaaaggtaaacaaaagcaatgctgcccatatacaaatgaaggtaaacgctttttgcccggaaaacggttcatgatacacaaacacgccgagcataagggtaatggtcggcgctatatattgcaaaatgccgacttgatacagcggcagacgctttgccccctctgcaaacaataacagcggcagggccgtaaatacgcctgcgaaaaataggagcgcccatgttcctgcccccaaggagccaaaagtgctcccgtcagctgtaaatcctaaataaataagtgcagccggggtaatcaaaagcgtctccagcgtcagcccgatcgtgctggacatgcgggttctttttttacataagccgtacaggccgaagctgaatgcaagcagcaatgcgatataaggaaccgcgccatattgaaacgcagatatgagcacggccgccccggcaatagaaacggctgctgtttgcatcttgttaagcttttcttttaagaataggatgcccaaaagaacggaaacgagcggattaatgtagtacccgagacttgcttcaagcaaaaagccgtgattgacggcccatatgtacacaaaccaattaacggaaattaaaacggaagcgaaaaaaagcgccagcaggcccccttccgatttcaaaagacgcagttcacgccatccggttttccacttcttaagcacagttaaaagcacacacatgaaaacaaatgaccataaaatccggtgagctaaaatgtccaatgcgggtatttgttcaagaagtttccaatagaccggaaacagcccccacatggcgaaagaacaagcggtataaatgattccttttcttacgttattcccttgcacggccttccccttcctttctgtaaacagattatattatatcacgggaagcttccggcgggcatatactatgttgtccgttaagaaagggtgagatgccgtgtttgattggaacagatattttcccttccaaaatcagttctctaaagaaacgtttaaaaatgctgatccgaaagatgtcgagacatatgtcaaccgagtgatggaaagcgtattcggcgccggttatgccggacagttcccttttcgcgacccgatgtccaaaaagaccgatccggtcgaagcggaaccgcccaagccggaaattgacctgtttgaaacatccgatcatgtttttgcgaaaattcccgccgaacaagaggaactcgaccgtatcaggattaagcatacgtcacacagcctcgttgtagagaacagcagcctgggagaaggaaaaaaagaaatcatacttccgagcctcgtcaaacggaaaggaacaaaagcagtctataaagacgggatgattgaagttatgttttcaaaacaggaagactacaatctatcggaagtggagattttaagataaaaaaacggcccgcgcgatgcaggccgttttttctttaataaaatggcggataaccgccggctcccggcccgaaaccgccgtatgggacgcctccgtatccgtaaccggcgaacccgtacggaaagcggggtcttgtaaaacctgtggcaatcacgcctccgagaagaccgcctaaaaatccgccgaataaaggagcgccgaacaaaaaaggacttctcgccggaaatccggcaggaccgaaattcccgcgatacaatgcatgacgagggtacatgtttttcctcctttatgtctgcctattcttaagcgtattcataaaatgaggaaattgattgggcggttgtaacaacttgtgcctctctctgatattgctgttatactttttttacaagttgcgacattataaaactgtcagggggaataaaatatgccattacttcgttttgacgttattgaaggccgggatgacgcagcattaaaaaaattactggataccgcccattacgccatggttaaagcttttgacgtcccagtaacggaccgttatcagatcgttcaccagcatcggcctcatgagcttatcattgaagataccgggctcggtttcaaaagaagcaaagatcttgtcatcatcagcattgtcagcaaagcgcgcaccgaacatcagaaagaaacgttatatcaactgatggctgatcagcttaaaacagaatgcggcatatcacccgaggacgtcatgatttccattacagaaaacgggaacgccgattggagcttcgggctcggtgaggctcagtttttaaccgggaaactgtaaaaggcctccccgcttgttctgaatgattgcaaactgaataaaagagggatgtatgttggttagtgagttgtatccttgtttgatatgcggatttaaaggattagagacaaatcccgtttataacggcgaatatcaaaaaacatttgatatctgcccttgctgcgggtttgaattcggctacagtgaggaccatgacgtaagcttagggtttattgtaacgcctgatcatttaattgaagcggcatttcagttataccggaaacagtggattgagggaggaatggaactattttctccaaacgatgttccggcggaatgtaaaaatgatcatttccttacattcgatgctttattaaagcaattaaaaggcttgaacctcaatctgaacaattttgatattaatggtttttatgacgattaaacattatcattaagaaaaggctgccttgggcagcctttattattcatcacatgtgtcgttcgcagatcccccgggctcgcaaaaactgtctgcccatttttgcatttcctgaaaaacggcttgcagggccatgcctttatcagtcagtttataaatgactttgacaggtgtttcaggcagcacctgacgctcgacgatttcattttgttccagctctttgagccgctccgcgagcattttttggctgattgtcggtatcgtttcggtcatatctttaaatcgtttcggcccgtccatcagtacatggataatgaggccgttccagcgctttcccaaaagagaaaaagcggattccattttaggacacattgtatatcccacgtgagttcatcccttcatctatgaattgacaagttttttgtgatccattaaaattagttttcgagttacatttagtaagcttctaacttttctattatgataacacgtttatccgaaggaggaaacatgatgacatccgtattagacgttttaaaggaacgcgcatctgttaaagaatacgataaagacgcggtcattacaaaagaggaattgacagaactccttgaaatcacaacgcaagcgccttccgcctggaaccttcagcattggcattttcaagtctttcacagtgatgaagcaaaagctgccctgcttccggttgcttttaatcaaaaacagattattgattcatcagcagttattgccgtattaggcgacttaaaagcaaatgaaaatggtgaagaagtttatgctgaactggctgagcaaggcaatatcacagaagagattaaacaaacgcttttaggccagattaacggtgcataccaaaatgatcagtttgcccgcgattcagcatttttaaacgcttctttagcagcgatgcagctgatgcttgccgctaaagcaaaaggctacgacacttgcgcgatcggcggattcaataaagagcaattcgttaaggaattcgacgtgagcgagcgtttcgtgcccgtcatgctgatttcaatcggtaaagccgttaagccggcgcataaaagcaaccggctgcctgtatctaaagtgtcaacttggctgtaagatgaaagaaacccttagtccgcttaagcggactaagggttttttataggaatcgctcactgtaccaggctcgtgcctgctcggcttcctgctgtgtgagctgatgaccgccctcctgccattcaagagcaacggatgcatgagcatctttcagatactgataaagctcctccgattcttcttttgtacataggggatcgcgttttcccgcaccgataaacacaggcagcccttccatatcaggcagcttcactccgcgtatcggcaccatcggatgatgcagaaccgctcctttcagtacatctttataatgaaacaaaagacttgctgcaatattggcgccgtttgaatagccggcagcaatcacgttttctctgctgaacccgtacatttgcgccgcttcatcaatgaaattctttaattcttccgtccgttcaattaaatctttctcgtcaaatacgccttctttcagccgcttaaaaaaacggggcatgccgttttctgacactgatcctctgacccctagcagacttgcgttcggatcgataaaacgtccgagcgacagaagatcatgttcatttcctcccgttccgtgcaaaagcagcagaacattttctgacgttccctgttcaaacacatgtttcatcatcattctcctttctccattttgggcagaacagctgtaatctgactgcgatgctcttccagccattccggaagcttcagctctgttccgagattttcaaaggattcatccgtcataaagcccggttcatcggttgccatttcaaataaaatgccgccgctttctctgaaatagattgaagtaaagtaagacctgtcaagaatgtcagatgaagcaagatgagaatcagcaagaatgtccttccactccgcctgctctttttcgctcgtgcggaaagcgacatgatgaactgtcccgtaaccgccggtacctgcttctttcggcgcaaggtcaacatctataatatgtccgatccgtgcctccgattgcagcctgacaatctgattttcttctcctgtctttgaataaccgaagcgttctatgagaaattgaatggttgcttcaggacggtacgagtacagaagaacacctctcatgcctgtgatcgcttctttttcagtaatgcccgaaggagtccattcactctgtccgcttctttcatcttccattatggcaagcggcaggtcttctgtatcattaaagagaaggacttgttcagacagcatgatctgttcttttacagacaagccgttttcttcaagccggcgcttccaaaacgcgagtgctcctttcggcacggaaaaataaattcttccggcctgcccttttcccacggttcccgggcggcttccctgaaaaggaaaaaatgtaatgatcgtgcccggctctccgttttggttgccgaaataaaagtgataagtggccgggtcgtcaaaattaacggtttttttaacaagccgcaaacccagcacttcagtataaaaccgaagattttcagcaggatcttttgcaaatgcggtaacatggtgcaatccttgtgtattcaatgtattcactcctaaatatcttgagttcgagatattaactattctaatttaatatgaatgaagatgcaactaaagtgtttcagttaaaaaagtaatagaattcttttttttctgaaaaatatcttgtgatcttatctgacacctgctatgataaggagcattatcaagtttcaggaggaaagtaaatggtcagaaaagcactaattttcgttctcatcttaatccctttcagccagctggccctgctgtcagtcgctaatcgggttcatccgatcattatcgggctgcctttttttcatttctggctgcttttatggatcgcagtcactccattatgttcgtttcttatttataggctgcagaagaaacaaggaggactggactgatgcccgcaaatataacagcattgatcattacagccgtcatcgttttaaccgttgtctgtatcggctttatagccggaagagacaaatcatcacgtacttctgttgaggaatggtctgtcggcggcagacggttcggagggctcctcgtctggtttttagtcggcgcggacctctatacggcttatacgtttttaggcttgacaagcaccgcctacacagggggaagcgtagctttttttgcaattccgtattctgttttggcgtattttattgcttatttctttctgccgaagctgtggaaagtggcaaaaatccataaattaacgacgcttgccgattacgcccgtgagcgttttgacagtaagcttttggccagtcttgtcgccattgtcggcgttcttatgctcattccttatatttgtctccagctgagcgggattcaagatacgcttcaggtggccggaacgggtgtcattaatgtcaatatggtcgtcatcatctcttttattcttgtagcgctgtatacttttttcagcgggattaaagggccgacgtttacggcgattattaaagacattctggtgtgggtgattatgctgtttatggtcgtctcacttccgctgatccattttcacggctggacgccgatgattcacactttggctgaaaaagcgccgcaaatgctgacgattccggactcggggccgaaaggaattccttggtttatcacagcttccatcgtatctgcgctggcgctctttatgtgggcgcatgcggcaaccggtgtatttacggcaaaaagcgcagatgccgtccgcaaaaacagcatgtttctgccgctttataatattgttttgattcttgttatctttctcggctttatcgcgtttcttgtcctgccggaagataccaatccgcggctcgctttattgaagctgattcaaacgtcttacggaggagtcgcgcagggctttgcttactccacgatcgcccttgcgtcattgattccctgctctatcatggccatcggagcatcaaacttatttgcgaataacttatatcgggatttgattcacccgaatgtgtcaccaagcaagctgacgttgatcacccgttcaatggtatttgtcgtcatcgggctcgcgcttttattcggtatgctgttcccgactgcgctcgttacccttcagcttctcggtgtttccggcatggttcagatctttccggctatcgccgtcagtctgttttggaagaatcaaacgaaagaagcgacaattatcggtcttctcgtcggtcttctcgtcggtcttctcgtgacatttacggtaaatatcacccaatccgcccacggtatatatgaagggttttggggtttgaccgctaacatggcagccgttattatccttaacccgttttttgtaaaaaaagcgtcttcaaacgccgtcaaagacggtttattcaataaagcgccctctgataaactgaaccaaaaaggcgcttaacagaaagaagccggcacgtaaatgtgccggttttttactttttgtgctgccatttgtaggtggcgacggtttttgccgggatgacggcttcaaactgccgattttctgaaacgacatggaatttttgttctgaagatgtctggttgattacgactgtcacaatggattgatcaggattaaggaacgatacattcgagactgtgtttttggagccgtaattactttctatccgctttgctccccggtcgataaattttgaaaagttgcctgtcatatgaaagatcgggatattccaatagcggtcagggtttttagcatcctgaataaacagcgtcgggtctggggtgcctatccaatgatgcgtcttaatttgactgtcgagcatcgtcacccacgcattgtagctcgacgcgccgttgcggaaatactgtgcgatccgatccgcccctgccgtcccccagacagaccgctccgttaagtgaatagattgatcaggatatctctttccgatttccgacatgacagaaaggtcaccgtcataatcgtgaaaagcgatgccgtctgccgcccggtttccttttttatcatctaaaatcggcggaatatagttccacgccccgctcgcattgtgatcataaatccaaattttcgtgtcaattatgtgttttttcaattcttttttcacggctatcgccagtttgcgctgctgagacggcggcatgtacatgctcggatagtcgatttccagcaatggttcattttgaagggtcatcgcataaatcggaattccctgcttttcgtacgcctcaataaatttgcggaagtaaacggccagtgcgccgatatatttatctttcagctttccccgcttgaggttttcattcgttttcatccaagccggcgggctccacggtgaggcgatgattttcagttccggatttatcgccagcgcttccttgatggttgctgtaatgtgtaaatcaatatccttttggatcgagaaatgacggagcttaggatctgtttggccttcaggcatatcgtcatacgtataaaattcctgtgccgtaaaatcagatgtcccgatcgttatgcgcataacgtccatgccgataccatctttgggatcaaccaattttttcagcacttcttttctttttgcgggtgtcatttttgataaattatggattgtggattcttccagggacgatcctacgcccaacacactttgatagcggcgcgacggatcaatatacacggcggcggagtcagaagccttcttttttgtccatgtaagcggtgtttgttcgtctaaggcgtatttcacttccagcggcccgtcataccacgtacgggaagccggatctttttcagaactgaaccacacccttactttgtttttgtctgaagccttccgatcagctgcatacacttcggtttgcatgctgcttgatatgaaaaagaaaaacataagaaaaaccagggtcatgtgcagacttttttcaaaaaacatgaaccaccatccctttccttatttttataagcgattctaaatgaaaagccggacagtcacctccttcccgcttaaatgaatgcgctttcaaaaccactgataaaaagccggcttcacacaacggtgaagccttccctttttacacctttaggatacatatgcgccgtttgattcaatcacttttttataccattcaaatgagtctttcttaagccgcttcattgaaccgttgccttcattatcccgatcaacataaatcatgccgtagcgttttttcatttctccggttgtaaatgacacgatatcaataattccccatggggtatagcccattacatccacgccatcatatgtgactgctttttccaaagcttttatatgtgacgataaatattcaattcttgaagcgtcatgaattgaaccgtcctcttctaatgtgtcaatggcgccgaatccgttttccacgataaataatggaatctggtagcggtcgtataagcggtttaatgtgtaccgtaaaccggtcgggtcaatcgcccagccccaatcactcgctgtaatataaggattttccacgccgtttggcaatcctccgtttacgacatccccggtattatcgtttgatacgtcactttttacggtagtggacatgtaatagctgaatccgaggtagtccactcggccgtttttcaaaatctcttcatcaccgtcttcaaagtgtatctgatagccttctctttcaaactcttttaacgcatagcttggataatatccgcgaacctgcacgtccgggaagaaaaaacgctgtctcatcgtttcttcagccagcatcacatcatcggggtgagatgagtacgggtaaatcgggacatgtgataccatcgcgccgatcctgaactcgggattgatctctcttcccttcgaaacagccaatgcgcttgccagcagttcgtgatggccggcctgatacatgacttcttttgcgttttcgttttctttaacggcgacgcccgagttcgtccataaaaagatcggattattcacatccatcttattgttgatttcgttaaacgtcatccaatatttcaccttatgtttataacgttcaaaacacacttcagcgaatttcacaaaaaacccgactgtttttctgtttctgaaaccgccgtattccctcgccaaatgcagcggcatctcaaaatgtgacaaggtgattaccggttcaatcccatgtttcagcaattcatcaaacacccggtcgtaaaaagccaatccttcctcattgggctcggcttcatcacctttaggaaaaattctgctccagccgatggacgttcttaaacatttcaggcccaactcgctgaataatgcgatgtcctctttataacgatgataaaaatcgatcgcttcatgattcggataaaattcccgctcttcaattgtatctgttattttccggggcacaccatgcgcgcctgccgtcatgacgtccactacactcggccccttgccgcctttattccatcccccttcaaattggtgggcggccagagcgcctccccataaaaaatcttttggcaatgtccccatcgtgtatatcctcctttatttgactgccgcttgcatgccgaataaatgcactgcagcagcttcaaccatccgcttcacaagtgtagaagaattcctgccttcattttcatattatacgtttacattataattgtaccggtataatttatcaatacataaacaattatagttaatttacgaaatggcttttaaaaacgattatgctataattctgaaagaagcgggacaataaatgaatgaggaatgtatatgttaaaataccagcaaatcgcgttagatattgaaaaatacatagaagaacatcagctgcagcaaggggataaactgcctgttctgcaaaccttaatgacccggtttaacgtgagcaaaagcacaatcaccaagtccttagatttattagaaaaaaaggggattgtgtttcaagtgaggggaagcggcatttttgtcagacggaataaaagacaagggtatatcagcctgctttctaatcagggatttaaagaatcacttgaagattttaatgtcacttccaaattattagcgctggaagtgagaaaacccacgcctgaggctgcccaaaatctgaatatgccgcctgacggcgacgtgtattatgtcaagcgaatccgatatattgacgggctgacattgtgtatcgaagagtcattttacaacaaatcgattattacgtatttgaataaagagatcgtggcagaatcaatatttgattatattagagaaggtctcgggttaaagcgcggtttttcagatttatatctgtacgcggggatgttaaatgaggaagaagcggagtacttaggtctgtttacaggagcgcctaagctttgcgttgaaacgatttttcatttaacaaacggccagccgtttgacttctcaaaagtcacctatcactatgagcaatcacagtttttcattcaggcgaacagccacctttttgaacaggaaacgacataaggcgggcttttcgcaaacaaaaaacaccccatgcgcgagcggcgcatcgggtgttttttactatttcatattcttatttaatgtttcaacggcttttttcatttgtgtatcgttgtccgcaagctgtttttgcagatccgtcatcaattttaccgttgtgtctcctgttaaaatgcctgtttgtttcagtttctcttttgcttggaattgtttgactgcttgttcaaatgctttatcatacgtgccgtttacattcacgctgtaccccagcgctttcagcattttttgcgcattggtgacggtcgttccggaatccccgtatttgtatgtttttttcgcatctaaatacggcaggttcgcatattcaggaagcttaacctgatattgcggtttgattccttttttatgaatccactctccgtccgctgtcagccattttgcgattgtcagtttaacggtagaaccgtcgctgtaatcttttgccgtctgcacggttccttttccgaacgttttctcgccgatcagcggaattccggatgattcatgcagcgcagccgacatgatttccgcggcgctcgcggtgccgtcattgacgaggacgactgtcggttttgtcactttgcgctctttcgtcgctttcatgacctctttcgtgccgtctttgtattcgacctgcatgatatttttccctttatcgataaacatgttgctcattttgatagcttcatccatcaggccgcccgggttgccccttaaatcgagaatgtatcctttcgctccttgtttttcgaggctgtcaatggctgaattcagctcttttgccgtcgattcggagaaggatgtgatttggatttcgccgatgtctccttttttcatttcagagtacaccgtttcaaccgggatggtgtcacgtttgatcgacaggttcagatcgccgacacccgctctgtgcagcacaagcttgacgtttgttccctttttgccgcggattaatgcgacggcttcgtttacattaaggcctttaacgcttttgccgttgaccttcaagatctggtcattcggtttaacccccgctttttccgcgggtgaccctttaatcggcgatacgatcaggatgctgccgtccttttcttccacttgtgcgccgatgccttcaaacgaagcggaaattgtttcttcaaacgactttccttcctgaggatccatataagaagaatacggatcatccagggaactgatcatgccttttatcgctccgtccactaatttgctgtcatctgttttttgatagtaatcacttttaatctgctcataggctttattgaatttctcaaatttgctgttcgtcaaagcagccgagccttgcccgaaaatggtcgtattgcccgtgataaacagcgtaagcgccgaggctgcgaccgcagtgatcaatataataaaaaacagtttaaattgccgcttcaagaaaacaccacctttttattcttacattattatcatagacgaacgctcattcgtcaacttcaaacgtgaggcgcccttctttcccgtttacccaaacctatgcttttctctcaacatatgctgaggaaaaaaggaggattcggcctttgagcaaatatttagaaatgctgtccttattcggagtcggaggggctcacccgggcgggctcgctttttccaaagccgttctcacaaaagcggctcctcctcctggcgaaccgattcttgacgccggctgcggaacgggacagacggccgcttatctcggccacctgctgtatcccgtcacctgtgtggataaggatccccttatgcttgaaaaagcagcaaaacgatttgccgctgaaggcttaaccattccgggctatttggcggagcttgagcggcttccgtttgctgaaaatcaattttccgccgttctttccgaatcagttctcaccttttcaaatcttgattcatcgctgtctgaaatcctgcgggtccttaaacccgggggcatgctgatcggcattgaagctgctttacaaaagcccatgccggaaaacgccatcacacagataaaagacttctacggttttaccgtattgcaggatgaaacggcatggaaacagagattgcttcagcaaggatttcagaaagcggatttcattcccgctgtctatgaaaacaatgcgcaggagccgactacagaaatggatttatcgcctgttattcagccggttcactacgatacgctgacggctcattacgagcttatgcagacgtaccgtgaatatatgggacactgcgcttttgtcgcttacaagtaaaacggcaattgtcctcctgttttcgtccaacctttttaccgcactctatcataagctgacatagaaagataggttggataggaggagaaaagatgcaaaactattatcatctttgccggcagcaccaaggaaaagtagcaagaattacagaacgaaacggcagagtccacgtcggaagaatcgtacgggtgactaacagcaaagtgtatatcacccctgtcggcggccgtcacagagggtacggattcggttattggggaggaggctggggaggctggggagcagcctacggtatcggccttggtttcattaccggatttgcgcttggaggtctgctcttctggtaataaaaaaagcccgctttctatttttcaagcgggcttcttctcattacactttctttacttcattaaaatattcttcaagcgttaattgatggtcatggatggcttttgccgcttttttgcctacatagcgtaaatgccatggttcatactcatactttgtaacattttctttgcctttaggatagcggatgataaagccgtattcatacgcatggtctttcacccatttgccgtccgccgtgtttccgaacgcttcattcagctcatatccgttgcttttgctggagatgtccatggcaagccccgtctggtgttcgctttgccccggatatgcgacggcttctttcgcctttttttcacctttcagactgacttcattatcgaaaataactttctgtctgtcataagagcggtatcctgaaacggcaaccaggtcataaccttcttttttcccggcgctgaatagttccgccaaagcatcggcggcaggtttgcggatatatcgtttctcgatcttctcagtaaaagaaaattcgactttcgggatcacgagatcattcggtttataatctcccggcagcgtatatgtcttattcacgagcgcaagtgtatttgtcgggttttgaatggtctcaagcccgttcacttctttaatatcattaaaatatttgctctccaatacaaaatcgctgttttctgtcttcgttgtttttttgcttgatgtgtcatctgattgttttgtttcagctgctgtttttgtgtccttatggctgttgccgcctgaaatgctgcagccggtgcccacgattgcggttacgctgagagcggcagcgagcgagaaccatttagtggatttcttcattttacccttacctttctttttttgaatcagggcgatgcataaagaagagggctgctttaatcagcataaccctcatctcaagtttacgatacagtatgcagcgccagtttaatcatatcatgaaaagtcgtttgacgctcttctgccgttgtttcttctcccgttaatacgtgatcgcttacagtcaggatagacagcgcttttttgccgtatttagcggcaagcgtatataaagcagtcgtttccatctctacgccgaggacgccgtatctggcaagcttttcgatttgggagtcttcattgtaaaactgatcggcggtgaatacgcttccgaccgctacgggaagattgtttttttgcgcttcctggtacgctttatgaagcagttcgaagtctgcgcaaggagcataatctacactgccgaaggcgacacggttcatctgtgaatccgttgaagacgtcatcgccaaaatcacgtcacgcaccttcacgtcattacggatggctccgcatgagccgactctgattaagttttgaacatcatagctttgaatcagttcattcacataaatagagatagacggaacacccatgccggtgccttggactgatacttttttgccgttatatgtacccgtaaatccgtacattcctctgacttcattatagcattccacattttcaagatacgtttccgcaataaatttcgctcggagcggatctcccggcaaaagcactgtatccgcaatttggcctttttctgcgtttatatgtacactcatttccttttcctcctgcctattcaaactcccacccattgtacactgaataacggtaagagacaatcatcagcatgatcagggcgatcttgggcagaatatgcgggatgacagcctaaagaaaaaggagtgaacataatgggcaaaaaacagcgcaaccgggtgaccggccagaaaaagaacaatcacgtgcccgtttcagacgtcattgcagctgatgaagcgcatggaaaagagcattccgccgctaaacggaagccttaacactgtctttcccagacaatacggaagccggctgaagattcagccggccccgtcttacctcggctggacgagcagccggttaattttgctccatcccgcagggttaagcctgtaataggtctttccttttcttccttcgtctatgagtatgacgtctccggtcgctatgaatctggcttgatagtcgtttgggaccgtatcaggcacattaaaaacagaaaatgccctttccagtgcgtcttgatgattgtcagcggccagctctgtccgatagacgaccctgtatccctttttctcgccgtagcggggtgtttgaaaaatcgtcacatcataggcacaagtcttttttttaaacacgggcagcgataacagcatcaagatccctccttcttatttcttaatagtattagcgttttttctcaattttcctgtctctatttttgtcgaaacggatgatacttttcgtcaaagagcgcaaaaagcgaaacgaggcaaagtccgagactgaatccggcaaggacatccgtcggaaaatgcgcgcccaaataaattctgctgaatccgatcagaatgacgagaactccggtaaagacggtgacggccctctttcttttcgtgaaaaacggaacatgcttgatcaaaaagtaagcgatgacgggatacatcactgccgaattcatggagtggccgctcggaaaactgtatgaggtttcatggacgagcggttcaaaagcgggtctggctctttcaatcaattcttttatttttatgtttacaatccgttcaatgagaaaaagaagcggcaaaaaaacaacatccggcgtttttttgtacatatacagagctgcgcctgtcaaaagaagaagcggcaaaagcaccgcggtcgtgccgagctccgttatccataacatcaattcattcagccagacagacctgatcctgacagccgcttctatcacacgctcatcaaaagcccggaccgcttctatccggatcgctgctgcgagcaaaataaacaatgtgaaaagacttgctggcttgtacaacgttttcccccatgtttcattctcccgagctgattgaaaaaaccgaagctttttcacttcggttccgcagtttcagtcttcatcaagctcttcgtctatcatacatttttctaataaataatcaaaggtgatgtcggctatttcgaagatttcctcttcactcggtatgtacccgcgcatagcaagctgactgtaaaaataatcagctatttcttctgtgtcaatcacaagatctatttctttcatgcaaacaccgcctccttttttatgttttatgaaaaaaccgttcaaattatacccgaaagttctaaacgttttgtccgctcatatacttttaaaaaacaagccccggagggagaaaagatgatgacgaaaatgatggctttattggacggagatggatttgatatcgtattggaaaaagtgctgaaaggaatgtcgtttgtcatctttgccggctgtctgccctggtttttatatgtcaccgtccgtttttttgccggctagctgaaatgctcccgcaggctttccagcacaaaattcatcatatctttatattcttcgtcaccgaacaaatgataaagaatcttataatcgttataaatatcaagcagctcatctacaatcgataccgccagcacatgcagggcatcgggatcatcagcatcgccttcaaactgaagaagagcagacgcgacggtatcctcgccgatctcatgagatgcttccccaacatagtggacaaacagcagctgatgcacaaactgatccatttcatattttctcagaaccagcgtgagatcctcttcctccgtttcaagccactctccgtctttcagccgagtcagctcataaataatatcctcccagccatcctctaaatatctccaaatttcagttctgtgaccgataactcggaataattcctttccgtagtcctttacatatacgacatcgccgatcaaaaattcatattcaatatctaatttttccatatcgacgatcacgccctcataatctttataaagctggatggacgattcaaaataaagcacttcattatgattgacttcataaagataatgtttatcaatttgatgaaccttcgtaatggtgccgacggttccgtacatcacgacgaccacgatgtctcccacttgaaatttcggtttatctggcttcatgctgtctcccccttgccgcggactgtcatacgctatcgtatgccggccgccatcatttcgcatgggcatgaaaaccacaggaaatatctatttctgcacctgttcaaaatgtcaaaaaccgcaacatgcttgtgcgttttttcacttaccgtaacagaagcgtctgatggcattgcgctctcgatcgaatgagcagtaacaaaaagcgcctgttttgaatgagtttttgtttatttctccatgacgcaaagataaatacccggcccgaaggcatgttgacaatatcaccgccgtgatgttcaaaatttgccgtgaaacacttcatcgaaggtgtatggtgatccaattccggctgcatattcgtaatggcttgtttatcatgaagaaccaaactcgtttcggctttcaatgaagccacaacttcaatccgcttcaaccttgtcacataaaatcaccttttccgtccaaacgtcagtgcttcaccatagatcatttgattcctctcacttcatttaaatgtttgatgatttctccgtgaaaagagctccttacacggaaccccgcctgcagcaggcctgatccggtgaactctgcagctatacattctattgccttatgatccgtgccgtcaggaagatttgtttacgtgctgatcaaaacggacggcattgcgggatttgatcatacggcacctcataagcgagtgatttcaacagaaaaaaaccgcacaatgtgcggtttttcgtcaggcgtgatgcacctcggtctcatatttttcccaagcttcatcaaatgtcgacatcgtttctaaatagtcggcgctcagttctaaataagaactgagctcgtgataatcgcttgacgttttcggaaagccgtgatcttcgtatgcctgattcgcaaaccggctgattgcgtcctgcggtttgggatgcctgtatttcatcaaatagtgataaaaggatttcatgggtttcccctcctgatgactgtcttttgttgtactattatacaattcaagtgtgaaattacaacaaaagaagactaggagaagtcaaaataattccgtttcaagatccgttctgtcctcatcagctcttgatatgtgagtgtttccggtaatttttttgcattgactaaaaaaagctgattttcgatttccgctatgaccgcttcctcctgatacgtcatgccgcaggaggaacaggcgaatgcgggtgtttctgtaatttctatggctcccgtaccgtcaggaagctcccagtacacagccgcctgacaagctgacgccttctgattgccgcaccactcgcatggcttcacggcgactcacctccgacttccgatcctgctttttgctctttcttttgctgtgcaataaatttcttttctttcaattcatctctcttttccctgcggtctttcagcgtttcatgatcagggtttgatgtaaacgttttccttctgtcgattctcgatacattttccggtgtgaacgaaacctctttgtccgcgaaaatggcgctcagtccgaccggctcgcgtttggccattgttcccggaaaaacagattcaaaatagtcgtcggcttgattcgggatatagttttccggctcgggataagatgtaatcaccccttcgaagtttctgatcactactttctccggactttgggagagcaagtagttcggctgcagggcgattttaccgcctccgcccggggcgtcgacgacaaaggtcggcacggcaaagcctgttgtgtggcctctcagcccttcaatgatttccaatccttttgaaacaggcgctctgaaatggccgattccctctgacaaatcacattgataaatatagtacggacgcacgcggattttcactaaatcatgcatgagttttttcataatcggcaccgaatcgttaatgcctgctaaaataacggcctggttaccgaccggaacacctgcgttaacgagcttttcacacgccgcaaccgattcttccgtcagttcgatgctcgtattaaaatgagtgttcagccagaccggatgatattttttcaaaatctgacaaaggttatccgttatccgctgcggaaatacgacgggcgctctcgttccgatcctgataatttcaaggtggggaatgtcacgcagttttttcaaaatatattccagaatctgatcgttgattaaaagcccgtctccgccggaaatcaggcagtcacggatttccggcgtttcctggatgtaagcgattgccgcatcgagctgttttttcggcacccccattccgatctgtccggaaaaacgccttctggtgcagtatcggcaatacatcgagcattgatttgtcaccagaaaaagaacgcggtcgggatagcggtgcgtaagaccgggaaccggtgaatcttcatcttcaaacagcggatcttcaaggtcatatttcgttttgtgcatttcttctgacagcggcacggactgcatgcggatcggacatctcgggttatcgggatccattaaagaagcataataaggcgtaatgttcaggggaatggtttttacagacatcctgacgccttcttcttcctcttcggtcaaatgaatgacttttttcaggtcatcgacggttcttacagtatgggtgagctgccacagccaatcattccacttgtcttccggcacatctttccacaattcaatctccttccaatgacgcttcggctgaaaccatttgtttgtcaaacgaattcctccttatgaatggccaaacgtaaagtcttgcaccatatattcatattttcgagcccttctgaaatgcggcagttgttcacaagcctgcctctgtagccgtatcccgcatgatacaaaacggcgttcatcccgtaagacgctgcacgggccaaggaaaaaagatgaatgattccccggccagcgagttcctgctccaacgctttaaacaagtgtgccgttacggagttccccctgtaatctgacagaaccgcgcaatcggtcatttcagcgtgccccaataccggattgatatctgcgcttgccgccccaatgagacgatcctgatcgaatgcggcataatagatggtgttttctttcattgtttttttaatataaagggaattaaagacaggagtcggataggtaagaaaaacatgtttatataagtgcgataagcagtctgcatcatcttcgtccgcttttctgaacatcagcgtgctttctgtttgagtcagtccccgccgcggtgtctcatataaacagtcaacagtcgaatcttctgatacatatgaatctgaccgtctccgttcctctgataaatagcgcaccatcacaacagcctcatgcccgttgtaatacccgtctatgacaccctcaacaataaaaagatgcttgacaaattccggctcatcgccgcgcttggcaaagaaaatcaccttttgggctccttcttgctttgcttctgccaaaacggccggtataagcgccgtgatctgtccgtcataacgaatgaccctgatccgctcattgaaacggtctgcatcaatctcggccgctccgctttcagccctcagttcctttatcagctccgtcacccccatctgccaccccgcaccattccatgataaaaagagaaatgattttgacggcatcgattaacgcccggacttcaatgtattcattcgcctgatgcgccgccttgacttctcccggaccgaagacgatgaccggtgtctgtcccgcgtgctgcaaaagccctccgtccgttccccacggggacgcttcacgaactggttttgcccctttcattttctcaaaagaagattccagagcggaaatcagcggatgctcatccgggagatcattcggaagccactgagctccaaaccattctatttccgcggggtggtgtttaaaccattcatcccggtactccaaatctttcagccagcttgccagctcttcttttactgcttcgggcgtttcatccggcgctattccgcacctgccttctatcaccacacggtcagctaccgatgatggccacgttccccttggacggtgccgatattaatgggaaccggaatcggaacgtcccgataaagcgggtctgtgatacgggcgttgcggacgtgttcaagctctttaagggctgtgatgacatgcaggcttttttcaatggcgctcaccccttcatagcgggtgccgccgtgtgcggacaatcctcttaccgtaatgcggaaccacatagacccttgctgcttaacaaacagctttaaattagtcggttcgggaataagcgccccgtcagccttgtagcccctcataacagccgccagtgttcccgcgccgccgcactcttcatctacgacactttgaaacagaacatctccttttaacgtaatcccgcaggcttcaagcgcttctaacgcaaacaagagggctgtattgccgcccttcatatccgttgaaccgcgtccgtaaactttgccgtccttttcaacagcggtaaacggttcatacgtccatgcggcgggatttccttccgggacaacatcaatatgtccgttcagtatcagtgatcttccgcccccggcccctttctttacggctgtgatattcgggctttcatggaagtcttcgcgttccgatacaaaataaggatgctctttcaactgtttgacactcggctcccagacatcaatatccatgtcaaactgtctcagtttttctaaaacgactgcctgtgcgttaaattcatggccgaacgtgcttttttccccgatcagccgtttcagcaggctcaccgcttttgctgtgttttcttccgcccactcagtgactttcttttctaattgatccatggacagacccccttttaagaaaacattctcccaatctgatttcggcatccgttgtttgaatgacatcgtctatggtcgtgccattcagcagttcctcaagaacaaaagctccctcatctatgctgatgacggctttctctgtaatgatgagatctgcacagcccgctgctgtaagcggcaatgaacagctttcgaccagcttcggccggcctttctgatcggtgtggctcatgacgacaaccacttttttcgcgccttgggcaagctccatcgccccgcccattccgggcacttttttccccggcacgagccaattggcgagatcacctgtcctgctgacttggagcgcgcctaaaatggtaatatctatcagcccttttctgatcatggcaaaagacagagctgaatcaaaataggaagcacccttaactgtactgacaggaaatccggccgcattgcataaaagctcatcctcctctccgcgctccggactaccgccgatcccgaggacgccgttttccgcctgcagcattacctccatgccggccggcagaaagtccggcactaaagaaggaatgccgatccccaggttgacaatcatacctgaggtaatttcactggcggcccgcctcgcgatactctctctttccgctattcccaagcccatctccacttcactccttcactttgcacgacaccctctacgaaaacgcccggcgttacaatatgctcgctgtcaagttcgccggcaggcacaatctctgccgcctcagcaaatgttctttcggccgcagcagccatcagtgggttcatgttgcgcgccgttttgtcaaacgtcagatttccgaattcatctgcaatatgcgcggacacaaaagcgaaatcagccgtcagcgctttttcaactaaataggactttccgtcaatcgttacggtttctttgttttcacaaacggttgcgttatcaatgccgatatcagttaaaataccgcctagccccgctccgcctgcgcgaatccgttcagcaagcgtcccttgcggcgaaaattccacctcaagcgctccgtcagtcatttgtctgcctgcgacaggatttgaaccgatatgggaagcgatcagcctttttacccgcttatgaacgataagcgggccgataccgatttccggaaatccggcatcattgcagatgacggtcaattctttaacgccgctttccaaaatcgcttcgattaatgacggaggtgaacccactcctccaaaaccgccgaacatgatgacagattcgtccttgacatcggcaattgcttcatgaatatcgatttttttatgaaaaatagacatatcagctcaatccttcttcatcattttttcagcttcttctgcggactgggaaaatagatctgacagctcatccagctccgcatatgaaatcgtgaatggcggggcgatgatgacggcgtctccttctccgctgtcaataccgggctttgcagggtaaataagcaggccccgtttttttgccgctttaatgattttttcggtgaaggcctgttttttcgaaaaaacgtccttcgtcgttttatccttaacgaattcaaccccgatcaggaggcctttaccgcggacatccccgatcaccccgctgcggtctttgatttcttctaatttccgcttcagcattacgcctttttcctctgactgccgaagcagctcgtgtttcttgacatagcgaagcacttcaagcgccgctcttgcacagtatgggttggcactgtacgtatgtccgctcataatgaccccggagccccgcttgatcgtttcaatgatgtcatcagacgcaacagctgccgcaatcggagcgtaaccggcgcctaacccttttccgagcaccgcgatatcaggggcgatcccccaatgctcagaagcaagcatccgccctgttctcccgagccccgtcatgacttcatccgcaataaacaaaataccgtgcctgcggcagacaacctcaagcgcttcataataacctgccggcggagtgatggccgccccggctgctccgacaatcggctctgcgacaaaacccgcgataaatgaggaaccgatccgctgaacagccgtttccagttcagccgccgcagctttcacaaattcctctcccttcagctctgaacgatacatattaggcgctgaaacggccggaaaccgttcaagcagctgggtgaagcggtatctccgttcgtagaaccccgataatgaaagcgctcccaaagtaatgccgtggtaactgccccatcttgatagaaagacggatttttggtattgccctttttcctgccaatattgaacggctattttcatcgctgtttcgactgcctctgagccgctgtttacaaaaaatgaccaattcagcccgcccggcagatgatcggccagaaataaagccagttcttctgccggagtactggtgaattgcgagcgatacacaaacgaaacggagtcaagctgctcttttaaagcttgtataatatcctccgtgccgtgaccgatattgcaagtgaccgcccccgatgctccgtcaagatacttgttcccctcctgatcatacacatatgatccctttccatgactgactgacggataatttgcgtcaagctccggtttgattaaatagctccccatatctttccacctcgaaaacccatttgcttcattgtatgaacagatgaataaccgcattctttccttcaaaaagttttttgcagaaaatacctttctgtaaaacaggctgccggagatgtcccgacagcctgaagagcgttctggaaattctattactactgttgattttattctttcttcggttctgctatttatctgctcagcttatcatcacatcatttttgatctgaatcagtataagcagaaggcggaaaattcccgtcttctttactgtatgggaatcaatatttcacacaaatgatgattcaccttttgtaaagtatacctttcgataatgggctgttctctgattgataaattatttttttcgatctcagaaaaaacagtgttccaaaatccgctgactgcctcttttgtatgatcaagcaagaaaacagcgtacttccctccggaaaatgtaccgatccgggctggttcaggcacatggtcttgattgataacaagacaaacatcatagcggcatttctctttaggagtacgattcggatgatcttgcggaattcacaaaatgacagaatgatcaagcaggccattcaattgcgcccagttttcaaatgactccatcagttctttgttttgctttccgccatactctccgacgtttcggaaataagcaattctggattcgggtaattcttcaatcgttatgttcacattttctcccccttctccagaaaggcaatatgtattaaaatgtttttcaagctgatttttcagcatggaaataacaaaaagcctgcagaaagtgatgttctctgcaggctgattttcattataggatttttttcagtctaacaaataaaagccgcaccgacgatgattaataaaataaacaatacaacgatcagcacaaaagtgctggttccgcctccgcagccgccgtgcccgtaaccatagccaaaactgccgcaaccgtagccatatccgtatccgtacatacgcaaatcatcctttcttcttacgatatacggcattgtatgcgggccaactcccaattggtttatgcgaatgcccaactatgtaagaaaataatgaaaaattgtatgcacgcgccgaaatcttttgaaaccgagtttttcataaaagcggtttacaccgtccatcccggacgtcacaaggtatacggtttccatgccgttcagctttgccgccgccatcagctcattcatcaatatcgatccgtagccttttcgttggaattgatccagaattgcgacttcttctatttttgcggttttatctgctttgttgatgaaaagctctccgcagccgatcggaatcgtttgcgaggcgtcgctgtagcacacgacaagcataaccgttccgtccttatacaaaggatatttccgctcaagcttttgttcggccgccgcctcgccaatgtaaagggcatcatagatgttcataatagacgacccgtcggcgaggcttttttccgtcccccaagcagtgagcgggtgtcctgcctgcaggtccccatttgccagtttccttgcaaaaaacagctcatcttccactacgcagccctgctttaccagagtttgtttcagaagaagcggaaatgcgtgctccggagacgctttcacatgaatataattggcttgaagcatgcccggaacggacgaaaaaaacggcagcagtttgtctaacggaaatgtacggtgcagctgaacaaagttatgcgaaaaaatctgcggcaaaaaagggtccgtatatacactgaaatgctcgaacctctgaatgccggaagtaagctctatatactgcttctcggttttatcaaattgatcggtcataaaagctctccttttccttacacatccgactgcatctctcaaccttttgttatattgagatttcttataatttcatcgtacaccggatagaacggcattccaattggtaattgtttaaattgttgaaaggaaatgggtatcgccttctgattcgcaaaaaagcgtttcgctacgtcatgactgatcggatggagaacccctctcaaataaacataaaatttccgttcaatgcgaaacagcattctcccgggcagatgttgaatacagcccgctgtcccccggctgatcggcggaccgtccggaagcgattgtatttcggcccgttctaaagccggaatgtcatgccgtttaaatcggtaaaagcgaaatgcgctatgatcaaccagccttttctccccgtcttctataaaataaacatgaaactgatccctgacgagctgaaaattcggaatactggcggagtcctcttcctcatattgaaataaaaacggatccggaatgacgacggttcggccttcatataacgtatgccagcgctcgtttacaggcttccttttatttcggtcaagctgatatactttctgatccgtcccctttacaaaggatccgtcgatcaggacagacggaagcgattgatacgtgttctgaaatgagtggggtgttttataggtcgtatccaacacttcttttatcggcagaaatgatgtaaatgtgttgagcctgctccaaaaaacagagtctccgtgattccaatggataacatcttcgtcccaaaagctgccgaacttctctttcacacgctcaagcaatgatctccggtgcatcactgaacagtgatcaacgagaaaagcggcctgatcaagcacctcttcagcgaaacgatagaagtggaattgttctgttccgcgcccgtttacatgtatcaccttctggctggaatagacggcatcaaactcgctgcattgattaagcgcttccgccatgcggctgagcctattcggatgaaatacggtgtcgtctgtcaaataagtgatgtattcgccttcggcccgtgaaagcgcatcattaatcaaaacggcataccgggtcgacttcagccgttcggccggattgataaaactgttgtcataatatatgcgatgatcttttatatacgtactgatggcagccgaggtttcttcatttgaatgatcatccatcacaaacagctcccaattgctgtaggtctgatgcaaaacactttcaatcgcctgtttcacaagatccggtttgttgtaactcgttaagataattgagatcttcttttccatcccatcaccccttctgtaaaacgtaaaaaacggctccgaaagagacagagcctgatatccgttattaaaaagcaccccagctgacgatgcttgaaatcgcgacgtttgatctcgtattattgagcggattttgaaaaacggccaaatctgacagcacttctttgacaattacgttctgcagtgtgctgccgttaatcagattgacgcgcggtacaggaaccccaagctcttttgccattataagctgacgccgcaaatctgaatgatctccggacggctgatgagataacaaaagaagaagaagcagtacgagctgaaattcctcctcaaaacccccgtgttttacagtttctcctgaatccaaaatattcctctccttcatttttttaatctatacaacgtatgtcatactcttacaatccgcataggcaaacaaagcctgattcgaaaattcagctgtttgattaaatattgaaaaaaacacaagcaaaacggcattcgacttataccaatctcttcaatcaggaatatgaataaacgtgaggttgaaattgttaaaggaggtgtatgtccgcatgagcgaggatcgtttggagcttaaaaagaacttattgaaaactcttttagcccctgtatttgacaacagcgctttatctggcggcacagatggaggagataacgtgaaaaacagcgtaaaagaattattggaatcggcaattgatgcaaaagtagatgaagcagcggcgaaagacagtctcagcgcacaatcagtattgggaagcggtatttcattagcggcgagatggatttttgcaagaattcagcccggcactgtcatcagcattgtaatggattcaggagacatgatcggcccggttcaatttgtttcctttgacgaaattcacggaatcgtttttgttacgcaggaaaattccgttacaccggcaggctctgctacaacattgcttgacgtcgacaaagttgaaagtgtcacgttcacttcgtaacagcatatgaacgttttatatatccgttcaggatataaaggcatatacacgtattttgaccgctggatcgaggaaggctttttacagtcttccgtccgctttttttctgtttctgagtttgaggaagataccatccgcagtatacgggcattcaaaccagacatcagtctgatgatgacgggagaccgtattccgtctgaatggcttcaatggctgaagacagaacagattcccgtttatctatggatgacggaggatcctttttatttcgatgtgagcatgacaatcgccccgcttgccgatgccgttttaacgatagaacaaaacgcgcttgatgcttaccggcaaatgggcttacagcacgtatattatgtcccgatccccgttaatcagcggctttttaagaaacaacctgctgaagcctctcttcacacaaatctgcttctgatcggatacccgtatccgaaccgcgttgaactggtgaaagcaacggcgaagcttccgtatacgcttcgtattatcgggaagggatggcgcagacatctgcctaaaaaaatcgccaggcagcaaaatgtgctcgtaatggatgaatggattgaacccgaacatgccgcattatattacaacagcgcagacgtggtcttaaaccctcaccgttcttatcggtttgcgctcaatcagaacggacgcggcatcgaaaataccagtttaaatacgagaagcttagacattgcggcttgtcaggcctttcagctgacagacctttctcccgcgcccccgttttcatcatttgtttcttacagcgggtttgcggattttgcggataagatccatttttatatgacaaacccgggtgaacgtaaacaaatcgcggcgcttaattatcaagagacagtaccggcgtacacgtatgaccggctgccggctgtgcttacggctatccgttccaagactttctcatgaaacgctcttcacatcaaaaagcagcttggataagctgcttttttcatgtttattttccgcttctgtcagtcagttttctcgggtcaacctgtttattgacctgcggatgaaagccgattttatcagcgattctttcccatggcaccattttaaaattttgattggccttttggccgtgatctatattctctccgtcctgtgcgacaaaaaggccgaacggatactcaggccccagcccgaaacccagaacgtcaattccgtctgtatcgcttgtgccgtctgtttcaggcccgtctgttatctgaaagtccgcaacatatttgttctgtccctgtctttcataaatcgcgtagctgctgttaccctggcttgaggcaagcagataacctttcccgtcagcagcgtagtaaatcgtcagtccttcaatatcaggggttaaatgcctgccgtcggcacgatcgataaccgttccgttactgccgccgtccggctcagcactgaacttccagatggcctcatcttcttctgcgatataaagactgccgtattcatcgtctgctgccattccttctgtctgagaattcattttaaacgcccttacctttttgccggatatgtatccatttttatccgcatttaattcgtattgttcaaattcgccttctttccctgtcaccatcgcgtaatattttcctgttttttgactgtggtacaagctgaaaccgtatacttcatcaattgctgatgcaatcgggcggtctggatccgtaatgctttgtaatgtgccgtttttcccgtcaatggcgtaaatctcaatggtattctttccttcagaccgattggatgccgccgcaatatcgactttttttccgttcaacggaaaatcatagcggatatcaacattgttcagcttcccggtatgataggaatgaagcatctttccctctaggctgtacacgactaagcctgattttttattggttgtgatcaatttgctgttctgaggattcttggggtccagccaaatcgcaggatcatcagctgcatcaccggctgtatcaacaggctccgtttccgccgccgcattcacggtaaaatgataaggatcagacagcttatgtttggcctgggaagaaaccgcaccgcatgtgagcatcaatccggctgccgcggttaacaaaagtgtttttgaatgattcattttccatcctccttttatgaacgtgcaatttaattgtaaaatacatacaggaagttcagtgttaagtttttgtgaagattgtccgcatgtgagaatttatggagagaaaaaattgacgtggacaaatatttaaaatgaatatttagtacaatgttttatttgtgatttctattctattaatcgggtaacgcgatatgaaagcgcatcagattaatgtttttctctaatttttgatttattggtttctttcattaactcgctgaaattgttcaacatatgatgcatggtagagaaacgagagttggaggataagccatgcctaaacagcaagcagtagagctacaaccgttttttcacgataaaactgttctcgtcacaggcggaacaggatcaatcggaagccaaatagtaaaacgccttttgctcttaacccctaaagaagtcattgtgttcagcaaagatgacagcaaacaatatgtgatgaaacaaaaatacgcggatgaacaaagactgtcgtttgtgctcggcgatgttcgtgactacagaagagtcaaccaagtgatgaaaggtgttgatattgtctttcacacagctgcgctgaagcaggttccgacatgtgaggataatccctttgaagccattcaaaccaaccttatcggcggacaaaatgtcgcagaagccgctttgctgcaagaagtgacgcatgtgattaatatcagtaccgataaagccgtttattaagatacttaccacaaacaaatcaaaaaaagaagcttactctgcactcctttccaaagcagcctccaataaatgctgagcaaattgtttataaaattcatctaagtcattactcgcttcatcctgttctatatagcggatactgtaattatctttatggacaacctttattgttttcttctttaattcctcataacgttggtaaggttccaaaactacacccccgctttcacaggagtattatatgtatgtaatggttcgtctcttgactgttctttctttatcaaagcctcgcaagcttgttcaaatgtatgatccagcgttcagtaccgatctcttcgcatatgaatatgagaatgctggctttattcaaggtgcccagtaattcaaaatgtgttcttgacatatgccttctctgcacctgagtcaacaatcgtcaaataaatcccggggcaggaataagccaccgcgaatgaagaatgacgtgaggtttgaagacattatttcggttcaatatgccgcttcagttttgcagcggtatttctgagaattaaagaataggtactaaatcctttcaaactttgagatatttgtttttagcggtgaagattcatttaattttttataccaaatacgaattttttgtcctttgcttaagtcatctttattgttaagctgactaagtcccagtaaaactatatccgatctatactttttaataatctctttttcactaagattttcatagtctttaacatcagctttttcattaggtatgagaattgcttgattctctccttttaaaatgacatagccgaccatagtttgctcagcctccataaaatgtttgttatgttggttttgacaccctaatgttatacataacaaaattaacagcattataaacactctatacaagttcaaaccgcccttcttgcatatttgtaacaagagtaaaacactgttttaggaaatgacagactaaaacgactcattcttatggaacacggcgaggtcttcaccaacatagaaccgcacaattgcatcatgaaatattcaattggctgatcaaccacaacaccttctttaagcggtctaatgtggaatacgtgtaaggaggcggtttatttgaaaaacgatcagaaaataacacttgactcttcttttgcgttatccactcttattgtcttacttattgcattgtacccgtcctattcttcttggtttgtcacaatattctttttaggatttgcactaatatacacatttgaaaaaagagcaaatcttcaaaactaattgctattatctcttatccattatttattgttgcgtttgtttacagcataataaacagcatgtaataatcctcccacctaaggcaggattatttttatcacattgcagcagcttttgagccgcctttgtctgtgatgttaaagctgtcactcccgattttttctttcgatccttatcttcataaatcgttacatggtcttttgtcattaaaattgccactgccatcttacattcctgcctatccttaaagtaaacaattttacattcacctagaatgatcattattagctaatccggctaatcagatgaccagccccctgtaggcaaattaaaagcaaatcctaatgtttaaacgacagtagcagttgagtatttgtcaaagttgatcgtagacgttgctttcagtatcattccaagtctgagttatctctttcgccttaactcctgccccaaaatcataaagcaaaccactcttcagcagaattccaaaaattccaattttaccaatgttgtttctcaaacctaattctccctctgagtgttttaataatattacactcagacgttaccctgaaaatattcataaaaccatattgtatttaatttttcctggactgcaaataaatcagaaagctttctttctgatactttgatatcaattttatataaggtatcaaacaattgtttgatagctcgtcttactggtgcttgctatatcaagattccttcttttcatgctgctcttttccttggcctcaattctttaaaattacgattttaagttaactttaaactgcattatgttgagaatatcacctttaattggtaagctgacaccagatcatacttatccaatgaaggtgaaatcatgaataaaataatcggaatgaccggattaattatctccttacttgtgcaagggttttcagcaagtgattcattgactcataagatcgccatggcttgtctatttttgttcttattggtttataattttaaccatactaaggagttctctaaaaagtctctcgctattataggcgcttcctttgttgtgctgatgcttggaatttatcaattgctcttttttactgaggattactttgaaaggcacggtttgaattttgggtttatcctcttacttgaaattgttttagttattgcattagtgactgctgcgctgagtttaattaagcatattgcagaccgcttaaggaaaacacctgatggtaaagagcgttgactctttgcctttttttagctaaccacttctttttatgccgtctttctatgtacaaaatcaaacacaatatcgacttttgccggctctcttctgtcaaatgatgaattgacttcaggcattccatcttaacggactcttcatcattttttaccataatttctcaaacaattaccttttttgacaatttgcaaaagatcaagcgcactgctctcttttaagagctctacatttctaatagcaagattggatattgtttgttaatacactcggccccaacttttgtgtcttagaatttgaaaggcgtacttgcactttaacatttgtcatttcagctgatatagaatcaatccttccagcccaattagggctctcttcctcgggagtcggatatagtttaaatcgccaactgatctcccctgttttgaaggcaaatccttcataaccgtcgtagcttccataagaagatggctgaggaaggtggacagcaagaatacttatattcgttcttgcagcacttggcgggtataactgcactttatagattagtgccgcacccttcgcatttttcaatttttgattcaccggttcgagtactgcactacaaggcattggacttgcttttatttgagttggagagacaataacagcagccaataaaggtataaccaagataaatcgtttcatctaaatcccctcacatttttttgttaatttcccttactcccgccttgaatattcatcacttttgaatggttagcttcattaaaaaggcagtactggagctactaacgctgccggtgaagatggaaaatcagcatatgaattagccgttcaacaagcagaacattagatgagtggcttgcctcactgaacgcaacagcaaactgatcatgtacccttctctaacgagggggttctatcgcattccacaccgaattgagaaattaagaaaaaacacccttcccaacatattacattatgataaaatattacataatcagacggaatactaggaggttgatttttttggagcaattgatctcttcttcaaaggttggcttaaaaatcaatgaatggtacaaatatataagattattcagtgttgcagatgcagaaattctaaagggtgaagttgaacaagaaatagagcatatggaagaagatcaagatttattgttgtactactcgctcatgtgttttcgacatcaattaatgcttgattaccttgaaccaaaaaccatgaatgaagaacgacctaaaatttcagacttatcagaagagatcgaaagtaaacaaagcgatctaaaaggaattcttgaatattattttaacttttttcatgggatgtatgaatttgaacagtacgaatatcttaaagcaataagtttttacaaccgagctgaaaagaagatatctattgtccccgatgaaatagagcgagctgaatttcactataaagttgctgaagtgtactatcacatgaagcaaacccacatgtctatgcatcatattgttcaagcaatagaaacctacaaagcacacgagacatactcaataagagtaatccaatgttcattcgtcatcggtctgaattatttagacatggagtatccagaaaaagcaataccgcatttcatgaatgcattaaaacaagcacaagaaattgatatgccacggttaataggatcttctttgtacaatctcggtttatgctcatttacaacaggacatatggagaaggcattggagtattttaaagaaggcgtctcaatttatcaaagtaattctcttcacaattctagccgactgcttgacatacttctaatgttggcaaaaacgcactttaaattattcaacacggttgatggaaaacaggtttgtgaacaaggtcttatgctgtcaaaggagttgaacgatgacgtattaggaaaaatgtttgattttcttatgggtttattcgttgagaatgacaaagaacgactttttaaaatcttagattacttagaatcaaaagctatgctttcagatgtggaagacctagcgactgatgcagcaatgtattataatgtaaatgaagaccataaagtagctacagccttttatgagaaagtgctttatgcccaaaaacaaattcagagaggggattgtctttatgaaatttaaatttgcatcggcttttatctttttggttatcttacttgggcttgttggacattatcttcttgacggccacaaagtttttaaagaagcccgaagaggccacacagccagtatccatatcgcgcttgatcaccataatgacttctcagcggaacgccgagggcaaaccgcataaatgttttggcactcccgcatagggggtgtttttttatgatctgtgttcacctgtagagctctatgcaatgctgtccttcatagtaaaacaggtaagccttattcatagctgcaaccaaaaaaagcacaaataaatagtattgctctaatcttgtgtggcaatcatacaaaaacacaaaaggaaccgacctagacagtaatggaggcgcacttttcacacctgcagatattgaccgctcatcaaaaactgtctgctcctaatcatttactttgcagatttattctgcaagtgtctttttattgtatataaaagataaggagcgttatatgaaaaagtcttatgttttatatgggatttcaggagttctaattggtgcaatagttatattgttgatcaatgcattctttataaataaaggtgaacactctgtacgtacttctaaaattaatccaaccgaggataaaatcttttttatctattcaaatccactcatcaagaaaagcgtactcatatccacatcccaaggagaaaaattcaataaacgatactttaaggtaccggatataccatatatccagaaaaaaaccccctcttcagacgatatcgtcttgttagctgaacatgaaccatattattacacattaaaaaacaacaccattaaagaacataaattatccaatccatttgctttttggtatcaaggagaagatatttctgtaaaagcctataatgtcgacaccaatggaaatgaactgaaagtaaatgataaaaagttcaataaaaaatatagcctgactttgcctaccctcgtaaccatgggaggaagcgatgataatgataagtatatttacgtcattcaaggaatgtctttgtacgtcattgatagaaaaacagaagagattattaaaacgattggattagcttcctatggagatgtatttgatcactctgaaaaatatgttgtggctagctcagaacatgaactaactgtaatcgaaaaaggatcatggaaagcaaaattcataaaatatcctgatgatctcgaacaagcggacgctatgtattacgacaaaaaaagcggtaaattttacgttacatatattaacaaattcggataaacctgcttacttgagtacgataaagatttttcttttgaaaaattcgatttaaaatttccgtattatgaatgcaaagtttaaagatcaaaaactttatgtgatttcacaagaggaaaacaaaaaaggcattggcggctatatggggatttttgatatccgtactaaaaagaaatttaatgaatttgatttgcctaaaaagaaacaaaagtgcaggactttatggttttagattaaacatcaagaatgagttgcaaagcaaaagccccttcctgaataggggctttaattttaaattaaatagatgttttatacgcgttaatggcttgatttctcaaaagcatattatctctcgtcaccattccaagattgtatgcttgtttgatgatatccagcacttgattatcagtttcagttacagctcgtcccccagttattctggacttccagtaatcaaactggtgatttaattccgaactgcttttaaggtttttattatcaactactttgccattctccagcgcttctttgaattcattaaaaccaattgaacattgctgattcgaactaattcctgcaccttctgtcgctaaactgcaaaacgctaaaaacttcggatctttcgtgatattgtaagagttatttagaccttccatagcattcaccctctctcaaattttgacggggtgtgaccaacaccatgctctttttattttatgcatttcttattaaaaagatacactataaccagtttgtattttacagtttgattataacagatcaaatgaaaccattggaagatttacaaaaaatttgttttttggataaaaacattttttatagattacacaagtgtaatacttttgcttaagtgtcccagtcttcatcctcaatccagtcgtctttcgcttcttctagttcctctattaaaaactctaggaatgtgctactaacttgtttaccatatccctcttggttatcccaaagaatgacggggcattcactatttttcatcttgttagtatcaagacaataagaaaattcatctacatattcgataactacgagaccatcggaaaggttataatactttttatattcattggtctgctcgacaacttcagcaccgtgagagtcataaccgagtatcatagtcccgtatgctccccctgaaccatactcagtcaaaaaccatttatagctgcctggaagggttacattgagatcctcttctatttctttaatctgatcttcagtaacacctcctgtgagaattgaattttctttattttcattgaagaaagttttcacttttgaataatccattaaaccttcacctcattatttttggttctcaaattgctgagctctccatctccaatactttcttctgaaacttttatattgtttatcaagtactgggtcatttctaaaactctgtccattccctttcaaaccatgtaaaacatcactgtacttattatgccagctttcaggtatctcgagcatatttccaggttcttcttgaatcaagtgatgcaaattaatttgggttccatcttttgcaaacggagcgttaccatttttcatcagttgaagattcgtaaggcctttccgatttttttgattaagatcaatatctttcattgtatataccctacggcttacatctctaggctgtcctttaacttttaccttaccgtctatttcgtatgcttcatatttttctttatttaaccaagggacattcactttctggcctgtaaatggctttcttgtttcatctaatttctttgcattaataaaaagttcatttttaaggttttggctgtcaaccacattgtatggtacgtcacccgacagagcaagatcatacttagagttataaggaagcaaatctgcaatcttaacgtctttaattttcttccctgcctgtcctgctttgtttatgaccttccccgccgcatctgctttgttaacggctcctgcgcctttcgttccgacgacagccacagctgctgaaccaattgcatatgtcacccatcttgatctggagtaagcatctccgttcaccatatctttttgatacgattcctcgattgctgctgaaacagcatcatatgttttaactggatgaagtactgcgtttcccagtgctgacaaggtttctcccggatcggttatgaagtcccatagaccggttaccgtgtctttcccgacatcatataaaccaacgccggctccttttaatatatcccaagtcacttctccggcttcttccagctgttttgcttgttcaagctgaatgacatattgctgctgggaaggttcaaggctttcatagccgatcttcttcgcaatttccaaatattcatccggatcagttacaacgtcagcgagctttttcttcagattcttgatttcctgctctttcgcctctttcttcttaaccgtcaaataagcatctgaatgtcttgcaatctcgccttttttcttatgtatatcgctttccttgtacgccttggcgttatagtgaagtggtgttgcgtttttccctttacccgtggcattttggagctgttgaaagtcggcttggatgaaatgctcgttcgcttcggtttctgcatattctttcgttagatcatgatcaagcttgccgagcttatgtatggcctcatcccgttttttatctgctgaatccagcttttgatcgacatcttctgtcgagaaaacttctagttgaatgatatcactgatttcatcaaggatacctttcatttcattgcgctgctcctgcatgatggcttgtgatttattcttcgcatgaatcagctcatgttctaaaaatgactcttccacaaacgaatcggtcaatccggcatcagctacttttcctgaaatgctgttaagaaaagcaatcttcatatcgatcaaatcaagccagctgtctgtgacactagcgtgatcttggaaaaaagctttaatgttgtcagcgcctttgcctgaaaactcattgtcatctaagtcagccatttcctgaaaagctttcctgagattgataaattgttctctaatctgatcgtattctttcgcccgcttttccgccgctgaaatgaacgaggctgcttcaaatactttcatagctgtctccttcccacttgattttatctaaactttctattctgaaacatatttataatactcttgagttttcgggctcacttcccagtattttgttccatttgaagacactaacatgtcaaaccatacctcaaagttagagtctaaatataccgtatcttcaatgtcatcaattgaatctagatacaacatatactctaatcccttatttgatttgtttgtgtcaataacatacctgccatcatagtggtatccaattaggacatagcctttagggaaatcttgaacttcattaaattcaattatcccttctgtgctaagaagctcaataccattaaacatttccattccgttgtgattgaataggaactctttataatcattaggcaaagttacccctaacatcttttctaaactattaatttcttgaggactggccggatctctgaattgaaaagcagcgtcttccatgacatgcccccatgttggaacataggaaaagttccgtatttagaaacagcatcctttattccattaagagtcatgtgaattaacttcccttcttccatataaattccctcctctaatgtttagaccactaaattttacctcaaaactgtatttgagtgtcttaaaatgccaaaacagaatttacaatctttggttttatatttataattaggaaggtttgtccgatatagagacagaacaaacaaatttgggggaattacattgaagaaatggttattaggtatttgcgcattatctttaagcttttctttggccgcgtgcgggtctgattctgattcttcagataaaacagattcagacaaagctaaaacaacgcagcaagaagaaaaggatgtaaaagagacaaaggcagacactcaatcaaatgacaaaagtactaatgacaacaatgaaaaagccgaaaatgcttcaaagaaggattcgtcggataaaaaggcgtctgacaaaaagaaaaggctggtcgatgtaacacttaacagaacagttgatgggaatacgattaaagtaaactataaaggcgaagtcaaaacggttcgttatttacttgttgacacgcctaaaactaagaagccaaactcttgcgtacaaccatatggtgaggaggcttcagcaagaaacaaacagctggttaacaagggaaaacttcaactggagtttgataaaggagatcgtacagacaagtatggcagaatgctggcttacgtttatgcagatggcaaatcagtacaagaaacactgcttaaagaaggattagcacgagtagcttatgtatatgagccaaacacgaagtatttagacacgtataagaaagatgagcaagctgcgaaagataaagacttgaagatttggagtaagaatgggtatgtgactaataaaggatttaatggctgcgcaacgaaaccgaagaaatcagtaagtgtatctaagccggctcaaaagtcagttacaacacaccaatccgagacacataaatcgaaccccagcaattcaaattcaagcagttcagcatcaagcagctcttctaactctgcacaagcctccccttctgctggaggaacagaacactttgcaaactgcacagagctgagaaagaaatacccgcatggcgtaccaagcactcaccctgcttatacatctaagatggatcgcgataatgacaactttgcatgtgagaagaattgataattttagaagtcctctgaggcttctttttttatttggatacattcaaaaaaaccacagagcgtgtgaaggactctgtagtctatagtggctgattaaacccctatgatacatcaattaggattttatcaaaacttttcttttaaagataacatcatctctgtctcaaataatgcctgcagcagttcatctatattaatttcgttctgcttgtaattattcttttcataagtacgaataatttcttcatattctgatcgattatctcctttaatggagctaattccaagctcttcaccatatcgggtaatgaataattgcttactcatttctttcgctttatcattttcataattacaaaatgcacctgacaactggacgagaaaagtttcgtcttcagaatttaggttattttcgttacaccagtctacaaaacgatttccagtcatggtatcacctttaattttagtatttaaagaacaagataatctgcagcaaggatgatatattctaccgccatgccaattgtttcagcaactcctgcgccaactgcacctttaatagctggtggaatttgttttcttgccatagcagcaacctctttaggagctccggttataccttcgagaaccttacaaattttgtttgtgtttttaataatcttgtttaccgtggactttccgaacattgtacctaaaatgtcttttgcccaagcattattcgctagtcctctaataaccttaatcgcttctttagctgcggcgcttttagctcccatagtactcatttgatcttgtgagttaccattttcgagaccttttaattcttcagtcgcatttaaaatgcctttttctttaactgacgggactgagtattctttagcaagtttttgaagctcggttggattataagtaaattgcacatcctgtttagaagtactcgcttttttcacttccgaggccgaagctccaacagttgggatggctataacggctgcaagcaacataaagagaattttagcaaatagacttttcaatttgaactctcatttatccctaattttattgtttaacacattgaacaccataccataaaacatttatattttttcctgtttttattatattcgtttaaaaaaggtaaggcagtcctacgtttgaaaccgttcaaaaatcactgcggtgatcaaatattcattcacaatttaagatatatttactacacaaaaaaggctgtttttgagacagtcttagatgtttttaatctatatatccgttagaatagatcaagattcaaacaatacaatccttacaatatattacgttattttcgtattcaatgtcagacagaatattgtacgaatacttctgtttttacagtaaatacaataaagaggaggtgctgattttttggagttaaaaaacatcgttcattcttacaacattacaaatattttgggttatcttagacgctctcgtcaggatatggagcgggaaaaaagaacaggcgaagatacgctaacagaacaaaatgaactcatgaataaaatactgaagccgattgaaatcccctatgaattaaaaatggaaatcgggtcaggagaaagcattgagggtcgccctgtttttaaagaatgtcttaaagacctcgaggaaggcaagtaccaggcaattgctgttaaagaaataacaagactcagccgcgggagctacagtgatgcgggacaaattgttaaccttcttcaaagcaagcgattgattatcattacaccatataaagtttatgaccctcgaaatcctgcagacatgcgtcagattcgttttgaattgtttatggccagagaagaatttgaaatgaccagagagcgtatgacaggcgctaaatacacatatgcggcacaagggaaatggatttccggactagcgccttatggataccggttaaacaaaaaaacatccaaactagtcccagtcgaagaagaagcaaaagtcgttcaattcatctttaacatctttttaaatgggttgaatggaaaagattatagttatacagcgattgcttctcacttaacaaaattacaaataccgactccatcaggaaaaaagcgctggaatcaatacacaattaaagcaattctgcaaaacgaagcgtatatcggaactgttaaatataaggttagggaaaaaacaaaagacggtaaacgaacaattagacctgaaaaggaacaaattgtagtatcggatgcacacgcccctataatagatcaagaacaatttcaacaatcacaagagaaaattgcaaacaaagttcccttgctgcctaataaaaacgcattggaattaagtgaattggcaggcgtatgcacttgttctaagtgcggtgaaccattatctaaatacgaaactaggcgaacgcgagaaaacaaaaacggcacggaaagtgtgtatcacgttaaatcactcacttgcaaaaagaataaatgcacttatgtgagatataacgatgttgaaaatgccattttggattacctctcttctttaagcaacttagataataagactttaacaaaacatatcatttcgatgatttctaaatacgaagacgtaaatagtaatgtgaaaacaaagaagcaaatgtctgaacatctttcacaaaaagaacaagagttaaaaaacaaagagaattttatcttcgagaaatatgaaagcggcatttacactgatgaactttttttgaaaagaaaagctgttttagatgaagaatttaaagaactccagattgccaagcatgaactcaatggaactcaagaagcgcaatcagaaatagacagtaatacagtcagaaacaacataaataagataattgatcaatatcacattgaaacaagcacagagaaaaagaactcactattaagaatggtcttcaaagatgttatcgttacgatgacacaaaaaagaaaagggccaattccggctcagtttgaaatcacccctatcctgaggtttaatttttcgctttcgatctcaccgccactgatagttcctcaaaatgcagtaaatatcttaaaaaaccgataaagccgtttccccggtaaacacaatgggggctacgaagctgttgtccgagaagctgtttcatcaggcaaatcatcatgttcaaaaccgcggtacggtgttttgttcggtccgcttcggcaatgtgctcggttcacgcggttccgttattcctattttatttgagcagttgatggcaggcggtccgctcaccattacggataaaaacatgacgaggttttttatgtcgattgatgacgccgcaacgctcaccctgcaatctgcggcgattacaaagggcggagaaacgtttatttttaaaatggaatccctgaggcttgaagaactgcttcacgggtttgaagaatatgcgttccggcatggactgccgcggccagccgctgttgaagtgggaaaacgcccgggtgagaagcttcatgaagaactgacctctcctcatgagacggaatctttatatgaatggggcaatctttacgcgatattgccggatcccgccaaacatccggaatttcggaaggtcaatctccccagatatcaatccgatcaggcgccgctcatcacaaaagacacaatcgtaaaaattattgaacgattacatgaagaaaaaaaaacatagaaaaaaggcctgtctgataggcaggccttattgctgagctctatttttcaaataaatgcaggcaggcttcatagccctcttccttcagcttgtctttcggaataaaccggagtgccgcagagttaatgcaataacggagaccgcttggccccgggccgtcattaaatacgtggcctaagtgggagtccgctgttttgcttctcacttccgtccggatcatcccgtggcttgtgtccagtttttcgtcaacctcttcttcctcaatcggttttgtaaagctgggccagccgcaatgagaatcgaatttatccagagatgtaaacaagggctttcctgatacgatatcaacatacagcccctcttctttgtgatcccagaattcattttgaaacggcggctccgttccgttattttgcgtgacttcatattgcatgcggtttaatgatttgattttttcttctttattaaaagccatcttatctgtccctccaatgctcatccagaaagccttgacgtccggaacctacacggtagcgcccgtagtgatcaggatttttcttataaaagtgctgatgatagccttccgcttcataaaaaggctcagcctttaaaatgtctgtgacgatcggctttttaaatatgccgctttcttcaagctgtttttttgaggcttcagcgatttgtttttgctcatcattatggtaatatatcgccgcccgatatgaacttccgcggtctgcaaactggccgcctgcatcagtcgggtcgatctgctgccaaaacagctcgacaagcttttcatacggataaatgtcaggttgaaatgtgatttgaacggcttctctgtgtccggtcgtttcactgcacacttcttcataagtcggattctcagtatgacctcctgtatagccggacaccaccttttcaatcccgggctgttcgtcaaacggcttcaccatgcaccaaaaacagccgcctgcaaatgtggcgatttcttttttttctgacatacgggtgccctcctttgttcatacgtggtattattatattatagcatgtataaacagaataaaaataattctgctctcaggggaagctgaacgaatgccacgctgactacatattggaggttcatgatttgaaagtaaggacacaaatgatgtatgatatggaagctttgcttcgaaaagtgtttaaacaaatcagaaatgaagttaatgaaattctagataaagagctgtccaggaacgaattcaccattttgcggattctcagtgaacaagggcctaaaaaagtaacggaattcgcccctattcttgaggtctccgcaagccacattaccgcagtgaccgacgctttagtagaaaaggaatggatcacccgcatccgttctaaagaggacaggcgaattatcagaatccatattacggaagccggggagaaaattgtcgatcatttcaaccagaaaaaaacagaatacttttttaaacggtttgactgctactctgatgaagagcttgcgacgttaatcaaactgttcagcaagctagacaaaaaacgctgacacaaaaaaacacaaatccctgaaaggatctgtgttttttttatgaaaacttattgtttcggatgataataggaaaattcaatttcatccgtatcgagattgattttatccgcttttacatacatgccgttgtctaaaggcatttctgacagacggatctcgatgcttttatccccggaatgaacgtgcacaaatgacgggagttcgtaaaagctgtccatataattcagcacaaagctgatcggcaggcttaattcgcctaatgaaaacttcgtcactttcaaaaccacatctccgttctcctgtacggacggttcaaatgtgacgaccgcgttaatggaggttgagaatgctttgattttacctgccacgtgcacatcgttattgatgtccactttgtagtcaagctgattcgatgccttctcttttaagtacgaattcacaaacctggcaagtgattctttggagcttgtgatatgaaagccgtactcactttttgtctgatcttgtattttcgcctgctctcccggcataaccaataatgtcacaattaccgcggcggcaatcacattgagtgcgagaagaacaaaaaacagcgatttccactttttcatcatttcaccctattctgctggtaacccttgtttttctatgatgccgtataatcggtcggcgatgagtgcatacccttttgcgttcggatgaaaatcatcatcctttgaaatccgtctgctgccgcttttttgactgaacaagtcttcaacattcaccgcagcggcgtggggatctttttccagctcttttgcggcgatcttgttccaatccgtcacaaccccattaatttcttttaattcaggcagcgtaaacgtgaacggattatacatgctgacatacaccagctctgcgttttcattatatttgcggatttttgaaatgatcgccttgaaccgtttttcaaaaggtttctcttccttttggaacggctgaaccgtcagctgcatcatattctggcggagcaccttcattaagtcattgccgccgatggtaaaaaagatatagtcggcgctctttaatgatttctgcacttttttattatcaagcttttccagcaggtccgacgttttgtcgccctgcaccgcataatttttaatatctaccgttttcacatgtccctttttcttaagagactccgctgtcttgccgacgtatcctgaaccgtcaggatctcctactccttcagtcaatgaatcaccgaccgcagctatgacaatatgatctttcgttttcggttcttcagcgtcagaaccggtgcgctggacagaacaagctgataaaagcaaagccagtccggcgatcaatgagaacattcgcagcttcaatctggttgctccttccccgtctactagtggaaagtgtaacatgttttttcagttttgaaaatgtctaatctgccagtttacttgagctcctcagccgctttgacatctgagaggatatcatcatacggaaccttctgcacgccgtcataatctttaagcaccttgccgtcaggtccgactaaataaaaagaagttttatgtatgacctgatcctctccctccggctttttgacgattgctttaaagctgttcagcgcaaaatcttcaatgtccttttggctgtaaccggtcagaaaatcccagttgcgaagcgaaagcggatatttggaagcaaaggctttcagctgtttcggcgtatcattttcaggatctacactgaatgacacaatccgcacgtccaggttctcagccttcagttttttttgcagttcggtcatgtgggccgtcatcggcggacagactgtattacagtttgtaaacataaaatcggcaatccagacatgccccttcaggcttttcagtgacactgttttcccgtcttggttctgatatgaaaacggctcaatctgatagttcagcgggtcttttatcgttttcccccgcaggcgcacaagagcagcaaacaaaagacggcagcgaagcttttcatttttttcatttccattcccccccatagataaaacgcttacagcgttcatcataaaaaaattcccgcaccctcccttatcaaaaggaaggcgctaaggaatgtgcaccgttatgcgttatgttttaaaatctcttggatgaaaacggcctcataatctttccacttcatacggcgcttgacatattgtcggaatgaatacactgttctcacactttgtgaagcaaaaacttctctcaaataaagctcaaggtgctgatgaatttgaaaaaaataatgttcaccttccgtgacaaccggtatttctgtcacttttacctgaatcccgtcctgtcgtttgaactctaggcttttgagtaacaagatatcaatccttctttttcgattgttttctttttattatatacaatctgagaaagcgtgtctgtcattttgcgcggccgttctaaaaaaagtcagattaacaggtggaacagatcctgatctttattcacctctacgtaatgaaatcctttttgattcatccgggcaatgagcgcgccgtaatcttcccgatgcttaagctcaatgccgaccaatgcggggccgctgcttttgttattttttttcgtgtattcaaaccgggtgatgtcatcatcaggaccgagcacctcatcaaggtattcgcgaagcgctcccgccctttgcgggaaattaacgataaaataatgctgcagcccctcgtaaatcatggagcgctccttcatctcctgcattctgccgatgtcattattccctccgctgaccatgcagatgacgtttttccctttaatctcttctttgtacagatcaagtgctgacacggacaatgcacccgccggttcagccacgatagcgcattgattatataattcaagaatcgtgctgcacacttttccttccgggacaagcaaaacgtcatcgacgatggtttcgagcgtttgaaaggtttcagcgccgattttttttacggccgccccatcgacaaatttatcaattttctcaagttcaaccacttgtccggcttttttcgattcaaaataggaggctgcgcccttcggctctaccgctatgatttttgtatccggcgagatgtttttcatgtacgtgccgagcccggacaggagtccccctccccctacgcctgcaaaaagaaaatgcggttcaacatcaatgtcatttaaaatttctatggcagccgttccctgtccggccatgacatcgggatcgtcaaacggatgaataaacgtgcggttttctttttcacagcattccgcagaactcttatacgcatcatcgaaagtgtcacccgtcaatatgatttcaacaaattcttttccgaacagctccacttgggatactttctgtctcggtgtagttgacggcataaaaatcttgccgtgaatgccgaggtgtttgcatgaaaacgcaaccccctgcgcatggtttcccgcacttgcgcatacaattccgttttcagtctgctcttttgagagctgcctcattttattataagcccctctgagcttaaatgatctgaccacctgcaggtcttctcttttcaaatagatattgcagccatacctctcagaaagtctgtcattcctctgcaaaggcgtatgtatcaccacgtcctttacgttttggtgcgcttttaaaatgtcttttacctggatgagagagtcttctttaagcaacggtttcatttacagagtcctttcttatttaaatccctatttaatatgccattataacatgaatattcgaacaataagataattattttaattttgtaaataaaaataaatgaaccgatacaagagaaaaagatattttcgatcgcataaacgtgttatacttaaaccaattagaaccaaaaggagccaattcatgagtgtaattgaacaaactgatcctttttatcagctagccggcgaacatcacaccttttcagaagcgaaacgattggcctcgcaatttgccttatctgatttgccagtcttcataacaggtgaagtcggaaccggaaaaaaacaaatggccagagcgatccatcataaatcccgcagaaacagcgaactatttattaccgttcactgcagccaaagcgaagatcggctcgaatatgaactgttcggcgctgaaggtgcattaaacagagcccgccgcggaacattattcttatatgaaatcggagacatgccgctctcggtacaggcccgccttctttccgagctggacgccgggctttccgcccgcatcattgcaagcagcacggcgaatcttggcgataccggcgcggaaaacacgttcagcatagatttattttacaggcttcacgtgttatgccttccgctccctgctttatctgaacgaaagagcgatataccgcttcttctgcagcatatgctgacagcctcgggacagcatattcatatcgacccgtccgtttatccgctgtttgagcggcacacctttaacggcaacatcagagaacttcaaaatgcggcgcactatatggccgcggcagcatccggcagcacgatttatcccgagcatgtcccgccgtatatcaaaaacagccagaaagcgaaaaccgctaagaaaaaagaaaaacggctgacattgatggagaaagaagagtttttgtttattttggaagcaattaaagacttaaatacaaagggcgaacccgccagcagacggagcatatccgaattaagcgaaaacagcacaatgacattaacgccccagcaagtcagaaataggcttgattacttagaaaagatgaactttgtgacaaaaggccggggacgcgcaggaacaaaaatcacattagaagggttgacctttttgcagtcactgcaaaaacaaatcctttaaaaaggaggacatttgattgttcacaataaaagaagaaatcgcaaatgccgtcacacacggaatcggtgtattgctgtcgattccggcgcttatttttctcattatcttcgcggtgaaatacggctcgccgacagacatcgtcagcttttcaatcttcggcacttcaatgctcctgctgtatctcagctcgactcttttgcacagcatccagcataaaaaaacgaaagacattcttgagattgtggatcattccgcgatatacgtattaatagccggaacatatacgccatttttattaggaccccttaaaggggcgctcggtctgacccttttaattattgtttggtcgcttgccatcggaggcatcgtgtttaaaatctttttcgtgaagcggtttatcattttttcaacgcttgtctatttaatgatgggctggctgatcatcatcgccattaaaccgctgtacgcttcgctgtcaggccccggtttcggtcttcttcttttcggcggcttattgtattccgccggcacaatattttatatttggagaaaagttccgtatcatcacgccatttggcacagttttgttttaggcggcagcgcctcgatgtttttctgtattttgttttattgcgtcaaagttccctttatctgaaataaaaaagcacagcctctcgtatagagactgtgctttttttatgcacggagccgtttctgaccggccggataataagcgggctttatatgtaattcaatgtcagccggtttcagccgtttcaataatctgccccgcagcagccggtctgttcccgaagtgctgacgggcacaatcgggagatcgaaacgtagggccagttcctccggattgattttgccgtcttcggacagaatcagactttgccctttctgcagacggacttccgcctcctgaagcactgcatcccggctgtctccgccacaaatgacacccatcagacgcagccaatttccgagaaacggcatccggaaagctttctcgccagcgataaaaccagccggctcttcaagatgtcccgcgagcagcagaagatcagccgggcgcaatttgggatgcacatacaatacggggccgtccgggatcggctgatcatgatgaatgccgattgtcgatcccgagacgtcaatacagcctctcataaaggctttcggccgttcatacaccagcctcatctgtttttgaaaagaaagccgcgggtcaagctctttttgattgatatattcctgaatatttttcatgaacataaatacaacgtacatcacaaggcagccgtaacgaatcaattcttgtccccctgcttaattctttttctcgtatacaaggtactcataatcgtaaggatttttttcattttttactccctgtttgcgggaggtcaattcccattcggcttcattaaattccggaaaaaaacggtctccttcaaagacatggtgaatttttgtcatgtagagtctgtccgcataaggaaagagcgcactgtacagctgggcgccgccgattacaaagcattcttcatccgccgggatcagcttgagcacttcctcagccgagcgggcggcaatacagcccgggaatgaagattcgtcccgtgaggttacaacgatgttacgccggttcggaagcgggcgtccgattgattcaaacgttttccgccccattacaatggtgtggcccgtcgtcacttttttgaaatacgcgagatcatcgggaaggtgccaaggcagatcgttatcttttccgatcagccggttctcatccatcgcaaaaataaacgaaatcatacgctgacagctccttttatgtgcggatgcgggtcataatcctcgatgataaagtcttcaaacgtaaaatcaaaaatagaatcaacatttcgcgcaaaccgcagtttcggcagcggacggacatcccttgtcagctgcaaattcacctgctccacatggttttggtaaatgtggacgtctccgaatgtatgaacaaactcacccggttcaagccccgtcacatgcgcgatcatcattgttaaaagcgcataagacgcaatattaaacggcacgccgagaaagacatccgctgagcgctgataaagctgacacgacagttttccgtccgcgacataaaactgaaacaggcagtggcaaggcggaagcgccatatgatcaatttcgccgacattccaggcgctgacgattaaacgtctggaattcgggtttgtcttgatgtcatgaatcagccgggagatttgatcaatggtctcgccgtccgctccgcgccacgaacgccattgagagccgtaaaccggtccgagttctccgttttcatccgcccattcgttccagatgcggactccgttttcctgaaggtagcggacattcgtatctccttttaaaaaccaaagcagctcatgcgcgatggatttaaaatggagctttttcgtcgtaagcatcgggaaaccttcctgaaggttaaaccgcatttggtagccgaacgtgctgatcgtacccgttcccgtacggtctccttttttttctccgttttctaacacatgacggcacaaatctttatattgtttcatttttttcatccttttaaagtagtcttttagtagtgtaacacaataaaaaatcatttctgcaaaatttctcagaaatgatttttttatttcttctcgctattacacgctcatccagtcaggcggcgtattgcggtcccagtaaatgctgccgagctcatgatgtgattgaaatccgtcttcagcggtatggtaatgaaaattaaaccagtagccgtcttgcggaggatgatcccggcggacgtggaaccttaaaagatcttcacctgtcagcctgttatacacatgaaaaattttttcggtttttccggccgacggtttactggaaataaccacatcctgatacgcttcatcatcttgaaacttggctaaatgtcctgtgatcacatcttcgattttcggcagaatttcacttctgtaatcatcttcaatgaccggagagattttgctgccgaattttaaaaatgattgattttcagcatcaccgagaagctgctgctgatacgattgaaacagtaattcaggctcccgccctgccttcgcttctcccggcagggcgtgttcatcataaaaagcggtgtaatcattctgctcaagactgctcgactgtcctgaaggcttgtctgtcatcaaagcagccggaggagacacgagtccgaacgttacaatggtaaacagaaccacaagggtctttttcatccacaatttcatgatagattgttcccctctgttttattgtcctcttttcctttattttagcatagattaaagcacggcgtcatgcccggcagcgtattatcatgcaatatgggaaattggtaactgtgaccgagcggataaaccgcttacaataagaaggagaaaaaggaggggatgagatgattaacgctttatttgcgactgtatcacttctcacgctgctttattttgtcgttatagaaatcactgattaacgaaaaagaagcccatgatatcatgagcttacatggatgacaccgaagtggaaaagcgccgtctttcttttcagcaccttgaagccgtgtcgttcaaaccgcgggcttttccaatggtctttaagcactacgcattttttcgccgcccggacggcttgcgtgatgcactcttcgttaaaaccctcttctgccagcgcgcggagcggtgcaatgccgtctgacgtttcaacaggttcgtgaaacatcgggtcaaaataaatgacatccaccgatgaatcaggaagctcccgcaaataatcggcgcagtcggcatgtttaacctgaatgcgtttcatggcggtttggagcggctccattccggtttcccacgtttgaagtcctgtttctacaagcaatgagacaagcttgtttttctccaggccgatgacttgtccgctttttccgactgccagacttgccaaaatcgcatcggatgccaggccgagtgtacaatctaaaaaggaatccccctcgcgtaatccggctgcttttaacaacggctcggcttcccctctcaaaaaccgctttgcgcggaacatcgctgtattcgggtgaaaaaagaacttctccccttgcttcgtgtaaagttcgaaccgttcctttccgataactaaaagatcgctagcggctcgttccagcattttttcaatgggctgtttattgcggctgcagtaagtgtcacccagcctgacactgagtgactgcgctgtgtgtatcgtatattcgcttggtctgtaactcgttgtaatcatctttttctccaaaaagaaaatgcccggaattcgggcatttcagcagtgcgcatcgaaggcatccgtcagatttttcataatttcctccatgtcatgcccttcgatttcgtggcggggaataaaatgaacgacctctttcccttttaacagtgccattgatggcgaggaaggttcctgccccgtaaaatattcacgcatttttgcagttgcgtctttatcttgaccggcaaatacggtaaccgtatgatcaggcgctttttcatgctgtaaaacagcctgagtcgcagccggacgggcaagacctgcagcacagccgcacacggagttgacaacgaccaatgtcgttccctctgcctgttccataaagctttctacttcttcagcagtcgttaattcctgaaaacccgcacccgtcagctcacggcgcatcggcacgaccagctggcgcatatattcttcataagccattgacataaaaaagccccctctaaaatccttatatgaagtcaaggatactatagagggggccggaattcaattgttcaggcctctgttttatattttcatgattccgcctgtattggcgcttgttacgagtttggaataccgggctagatatcctgtttttactttcggctcgaagcctttccattcggccttgcgtttttcccattcttcttcaggcacttgtacgtccaaaatccgtttttctatgtcaacgatgacatggtcgccgttttctacgaatgcgagcgggccgccttcagccgcttcaggtgatacgtgcccgattgaaagaccccgggacgctcctgaaaaacggccgtctgtaataagcgccactttcgggccaagccccattccgacaatctgagacgtcggagcaagcatctccggcatgcccggtccgccctttggcccttcataacggataatgacaacatctccttcttttactttgcggtttataatgccttcaagcgcggcatcctgagaatcaaagacgacagcgggaccttcatgtcttgtaatcccgtcctgtacgccgcctgttttgataatggcgccgtccggagccagattcccaaacaggacggccaaaccgcctttttcggtaaacggattgtcaagcggatgaatcacgtcataatcctttacttcatgacccgcaattgtttctcctagtgtgcggcctgttacagtcagcgcgtcaagatgaagcgccccttcttttttcgccaattcattaagggccgccgagactccgcccgcttcgtgcagatcttcaatgaagacgtccgaggccggcgccaatttcgataagtgaggcactcgttcagccacttcgttaatgcgttctaaagagtactcaaccccagcttcattggcaagcgcaagcgtatgtagcactgtgttggttgagccgccgagagccatgtctaacgcaaacgcgttgtcaatcgctttttcggtgacaatatcacgcggcttaatgtcttttttgatggtctccatcaattgggccgctgattttctcacaaactctcttctctccggtgaagttgccagaattgttccgtttcccggaagcgccagaccgagcgcttcagacagacagttcatggagtttgccgtaaacatgcctgaacaagatccgcacgtcggacagccgaactgttccagctcctgcaggtcgctttcaccgattttcccggcttgatatgcgccgacgccttcaaatactgaagaaagcgaaattttgcggccatcgcttgtacggccggctgccatcggccccccgctgacaaaaatggtcggaatattaatccgcatagccgccatcagcattcccggcgtaattttgtcgcagttcggaatgcagaccattccgtcaaaccagtgcgccgagacgaccgtttcaactgaatcggcaatgatttcacggctcggcagcgaatatctcatgccgatatgtcccatcgcgattccgtcatctactccgatcgtattaaattcaaaaggcacaccgcccgcttccctgattgcttcttttacgatttttccaaattcctgcaggtgaacatgcccgggaacgatatcgatgtatgaattacagaccgcgataaacggcttgccgaagtcttcttcttttacgccggcagcgcgaagaaggctgcggtgcggcgctctgtcaattccctgtgtgatcatgttgctgcgtaattctgccatggtgatccccctactgtttttagactgtgcattatttttaaaattttcagtttattctagggcgcgttctgcaaattacctgtttacagtgtctttgccctgtctcgcttttctattctttctgtatttcgataaaaaccctccaacaattaatattgtacttactatatagagttttgaatcatttttcaacaatattctaaataatttttataaaaagtgaattcaaataaaaaaggtgcatggcgcacctttttgttataactgttctttttttctgctttcagtcatttgtttccagactgaacctttcgcctcttctccgtgctcaatccgttcaatcgccattttaacttgcaggctgacttcgaattccggatcgtcttccgccgcttttaatgcttccagcgctgtttcatcgccgacttcatataaaaacatggccgcgcgccagcgcacgagcttgcttgagtcactgagcgattttatcattgccgggatggcgctcgcatcgccgagatccgacagacagtcacccgccgtccttctgaccgtcaccgttttgtcttcaagcgctttgtataacagcggaagcacagacggcttttcgatcattcccaaataaacgacggcttgtcttctgatcgaagtcttcggatcatgcagcgccttttccaatactggtaaatcgtcttcatccggatccatttgctcaagatgggcatagcgctgtttccagtcttcatcatcgagcatttccaaagtcactttataagctttccgctgcactgccggtttggcctcacccttttgctgtacggctgcttctgtcaggcgtttgagccgctcatcactgtaggcggcctgaagctcttctgtgacatcgtgtccgatttcggtaaaatccccgaagcgcacgccttgttctttccaagcccgctcaaatacaacatttgaagcttcggaacgcagctttaagatggcttcttggaaacgttccggaaggccgaagcgctcttcacgttcgccgtccgtcaatttgacctgcatcgggattccgctgaacatttgtacgaaaaccttcacttcaccgaacgattcctgttcagaacggctctcagactgctccgtatgttccattccgaaagcggaacggacctgaggcagaatgtccttccagtcaaaacgggcgtttctctccacagccaggaaatcggcaacgtgataaacgccctttactccttcaatgtttaaaatatcacgtacgacggccggagcatcatctgcctgatcgggcttgtaattgttgcttttccccgccggaagctcttcagtcaaaatcactttcatcgtgttcggactcggcgtcggttctattgatttaatcttcatattggtcctcctatgcgcaatctgacacttattctaacatagtcggcacaagcgttctattgcgccgcttagcttttgccgatgccggcctctttttggatacgggcggcgaactgcaaaagaaattgatgccgctcctctgctaaaccggcccccgcttttgtattcattaagcctttaagcttgattaatttatcctctatatgggccagcacacttgtttgagttccgtacatcgggtgacccttcgcgccggcaaacataaaagccctgccgatgcccgctgcgccgatcgcatcaagcatgtctgcatcctgaacaactttcccctccaatgaaagcggccgctttatcagcagttccctgtgtctgaatgacattctcgtgatgatatccgcgatctcctcaatggagccagccgcaatgttgaaagcagccagccgttctgtcacttcgcctgccgtcagcctttcgcttttttcgagcttggtgtcaatcagatcatgaaccagcgcggccgtctcagtgataaataagtcggcgccttcttcttttgccatataaacagaaagtgctgcgacccgggaaatatgaagccagtcatggcccgtacgttcattgataagcttttctctgacccaattcctgacgctttccagctgctctttttcgttcaccgtatcacctcttattgggccaaaagcctctgcaccgtatcttcaagctcttttgggttgacgttaggtgaaaaacgcccggtgacttcaccgtttcggtccacaataaacttagtgaaattccatttgaccgcttttgtgccgagcatccccttcgcctgctccgtcagatatgtgaagagaggatgagcgtctgctccattgacatcaactttcgcaaacatcgggaatgtgactccgtagtttttcacacagaactcttgaatttccgcttcgtttccaggttcttggttcatgaattggttgcagggaaatcccaatatttcaagaccttcctcccgatatgtatcatagagctcctgaagctgcttgagctgggatgtaaacccgcatttgcttgctgtattcacaatgatcatcaccttgcctctgtaagccgatagcgtcatgtcttcgcctgttatggtccgtacgtttatatcgtaaattgtcatctgcggccctcctttttacattcttcatttattttacctgttttacactgcaaaacaaacggtaaccgctttttccttccacttaacggaaaacgtattttccgaggaaccatacggctctttacccgtcataataaagagccgctccgaatttatgtccatttaccgcttttatccctgtcattatgcgttaaatgcggtttattacgccgggatggattgaaaaatggcttaaaaatttctataatgaagaaaattaacggggaataacggaggtggcatgttgcctattaatataccaaatcacctgcccgctaagcaggtgcttgaaagtgaacacatctttgtaatggatgaaagccgggcttttcatcaggatatccggccgcagaagatcgtgattttaaatctgatgccgaaaaaaatccaaacggaaacccagctcctcaggatgcttgggaattcacctttacaagttcactttacgttcttaattccgagcacacatactccaaaaaatacggcaaggcagcatctggatgaattttatacggatttttccagcatccgccacaaacggtttgacggaatgattattaccggggctccgattgagcacctgccgtttgaagatgtttcttactgggaagaattgaaggaaatcatggaatggagcaaaacgaacgtcacttcaacactccatatctgctggggcgctcaagccggtttatactatcattacggcattgagaaagtggagctgccgaaaaaaatcttcggtgtgtttgaacataccgttcttaaaaaacatgagagattggtaagaggatttgacgagctatactatgtgccccactcacggcatacagatattaatacggagcagctgcaatcggcttcggatctggatgtgctcagcgtttcagaggaagcgggggtctgtttaatcgtttcaaaagacgaaaaacagattttcttaacgggtcatccggaatatgataccgatacgctgcttcaggagtatgagagagacatagagagaaatctttcaaacgtagaagctcctaagcactattttgcgcccggcgggaaagaacctgttaaccgctggaaagctcatgcaacgttattgtttatgaattggctgaattattacgtatatcaggaaaccccatatgaatgggattaatttttgttttgagtgatacggtgacaaaaatatgataaaatactcttgattcagtatgcgtataacaaaactttaaaataatggaacatatcaattaaatttagtttaaatatgttgccgcgcttattataaaatgatgcacttgtgttatgtttatctatagacaataactccttacgatgcatgaagcttgcttgttgttgattacattgaggtgaatttacttgaataccaataaaaaagtattaattttgactgcaaattacggaaacgggcatgttcaagtggccaaaacgctctacgaacaatgtctgcgtctcggcttagatgtgacggtttccaatttgtatcaagagtcaaatccgattgtttcagaggttactcaatacctttatttaaaaagcttctcaatcgggaaacagttttatcgtttgttttattacggagttgacaaaatctataataaacgcaaattcaatatttattttaaaatgggaaataaacgtttaggccagctcgtcgaagagcataagccggacattattatcaatacatttccgatgattgtcgtaccggaatacagacggagaaccggaaaagtgatcccgacgttcaacgttatgaccgatttctgccttcacaaaatctgggttcatgaaaatgttgataaatattatgtcgccacagattacgtgaaggaaaaactgattgaaatcggcactcacccgaacaacgtaaagatcacaggcattcccatcaggcctcaattcgaggaatcgatgccgaaagaaccgatttataaaaaatacaatctctctcccgacaaaaaagttcttcttattatggcgggagcgcatggtgtgctgaaaaacgtaaaagaactgtgcgaaaatctcgttcatgacgatcaggtgcaggttgtggtggtatgcggcaaaaacagctcgctgaaagaatccctcagcagcttggaaggtgacaatgccgaccggctgaaagtgctgggctatgtagaaagaattgacgagctgttccgtattacggactgcatgatcacaaaaccaggcggcatcacactgacggaagcgacggcgatcggagtacccgttattttgtacaaaccggttcccggacaggaaaaagaaaacgccattttctttgaagatcgcggtgcggctgtcgtggtcaaccgccacgaagaaattttagagtctgtcacctcccttcttgcggatgaggagaagctgaaccggatgaaggacaatattaaaagcctacacctccccaactcttctgaagtcattttgcaggacattataaaagaatctgaaatgatggccgggaaggcggatatggcattatcgtaaaagaaaagcacacgaacgattcgtgtgctttttgtttttttccggttaagctttgttactggaaaaataaagataaaaaatagggagcggccgcttgacgcccgctcccatatggtgtatagttgaaccatcatttaacaacgtttacatacgtacggttggatgatgacaaaattttttttagcacgaaggtgctacagtactaggaggaattaagcaatatgcaaaacggtaaagtaaaatggttcaataacgaaaaaggattcggcttcatcgaagttgaaggcggagacgacgtatttgttcacttcactgctatcgaaggagaaggatacaaatcattagaagaaggacaagaagtttcttttgaaattgtcgaaggtaatcgtggacctcaagcttctaatgttgtaaaactctaaactcaatacatgttgatcagatgacaaatagaggagaggcgtatgcctctcctatttgattgccgtctgaatctcaattgcgacaagattctgcttacagcgctgctcgatttcttctatttgcttctcctttgacggcattcctttttttgccattttcgctaaacttcccaaatcaccgtatatttctttaaatgtctgctgaaggattgtttttaaatcattatcattcacggctggtttttcccttctctcccaagataccctgaataatagtaaataagccctaattaatcaggttcaatagttatatcggcttattttctatatttttttctattttccgtacatatttctaaaaaaaatctccaaactatttgcggaggtgttttttaatggactctgaatttttcccaaacggactgacggataaacgccagcttgaattagcagtggaaactgcccagaaaacaacgggagcggctacccggggccaaaattcaactttggtggaatctgcttaccaagcgattcaggatgccagaacgatgtcacaatccagtgaactgcaagctctcgaccaggattttctgcaaaagcagcgaatgcttctcgacgattgccagcatcagcttgatgaattcgaaaaataaaaccgcagaagctgcggttttattttttattgatttgtcagcaccttgccgtaggctttcagcttctcccccaccgtgcattggttgatacagaaagaatgagcgtgcgtttttccaaactctttgcggaaatgctttttcacgaaacagtctttgcaatattcatcctgaagctctgtcaattctttataaatgctttttttatccaatatcagtcatctccgttaccttctaatgttatgcggctttcaatttgccggtccgagagaatttttctggcaaggtcatccgcttcttgattttcctttcggtttacggcttcatatgccggtgtcagctttaaggattcgagcagcgcttcaattttatccagccattcgttttgcgtttcatcataacacggccagctgccgtcaagctgatgcaaaacgacgagggaatcccctcttatcgtgattgaatttctgcttgcgccaagttcctgcacttccttaagcgcttcgtacaaagcggcatattccgcctcattgttcgtctgaagcgttaagcttttgtttttccgtatgcgatgccgcttgccgccgagagaataatacacgacaattccgagtcctgcgcgtccgcttgttttgtcaaagccgccgtcgaaatacactgtaatgtcgtcaggttcgtacgcaagttcttcagtaagcttttctaattctttaagcgtccagctcgcgcctttttcatcctcaaaataaatgttttttatataaggaaagcggctgacttctcttgcaagcatgcgcgctttcggaacggtcagccaatcttcggaaaaaaacgcgacagagcctgttccttttgcttctatttcgatatacggcttaagattcattgaaatcaccttaccattcattagttgacgggcgtgtgctataatcaaaccattctcaaattgaaaggaagtcagcaggttttgtttaacgatgtgttatggagcttatttgcggtcattcattttatcattgttcttctgttttataaaggatttggcaaaacgggcctattcgtatggatcggtttcgccacggtgtgcgccaacttgcaggttgtcaaaacagttgagctgttcgggctcacggcaacactgggaaatatcatgtacggcaccgttttcttcgcaacggatgtgctgaacgaaaaatacggtccccgggaagcgcgcaaagccgtctggctcggcttttccactctgctcgctttaacatgcgccatgcagggggctcttttatataaaccggctgcgtcagatatcgcacagcctgcccttgagacgattttcggttttctgccgcgtgttgcgctcggaagcctcttggcttttattttcagccaaacgatagatgtttatgtatattcaaccattcggagaatctttccttcagataggcttctctggctcagaaacagcggaagcacggccctcagccagctgctggatacatttatcttcactgccgtggcctttctcggcgtttattccgcgggcgtctggttcagcatctttatttcgacttatctgattaaatttgcggtatcactcatttctgtcccttatgcgtatgcggcaaaacgaatgacaccgaagggagagtgagggatgatgcccgctgaaatttacgtggacggtgcaagcgccggaaacccgggcccgtccggtatcggtatttttattaaacatgacgggaaaacagaatctttctcaattccgatcggcgaccattcaaatcaggaagctgaatttctcgctttaattgaaggaatgaagctgtgtgccgcccgcggatttgagtccgtgtcattccggacggattcggatatcgtggagcgggccgcagatcttgaagcggttaaaaacaaggctttccagccgtttgttgacgaaatcatccgcttaaagaccggatttccattgtttttcattaagtggattcccggcacacaaaaccaaacagccgatcagctcgcaaaaaaagcgattcggctgaataaataaccggaatgaaattgcgtctcactgttcatcctacaaatgaggtgaacagctatgagaaaagaaaataaaggccggctgaccgggggcgtgaatcctcagggaaatatggaaggaaatgcgcataaagacccgaaatcagcccttgaaaacaacgcaaaaaaaagcaatacaaaacgctagagggatcagctgatctctctggcgttcagcttttcgagcattctttcaattccttttatctgatggcgtctgagcattaaggatgcttcttccatcttcaatgaaaaaagtgcttcttcaagcgtacagactaacggcacctcgcaatgtatttcagcaagctgccttgacagctccaattctttcaagctttgctgaattttcgtttgctggcccttcggcaagagagcgaggctttctaataaccgttctatgttttcgtattcacggatcagcttgtacgccgttttttccccgatccctttaacgccgggatagttatcgctcgtgtctcccatcagcgccttaatgtcaatcagcgcttttggcggaactcccgtttcttctctgaatatctcatctgtatataccttataattgccgatacccttttgcagcagcgctacttgaacttgttcattcagcaattgaagcagatctttatcacccgttacaatcgtaatttccgcttccccggcaaatagggcagaaagcgtaccgatacagtcatccgcctcatagccttttatgccgatgtttaaaaacccgagctctcgcgctgcttctttcgctaaatcaaattgcgggatcagctcaagcggcggttcgcttctgttggccttataatcttgaaacaaatcattgcggtacgttttgctccccatatcccagcagcagacgacatgtgtgggctgaaacgtatcaaccgccgtaatgagatgctttagaaaaccgttgacgccgtttgtcgggattccgttttcatttatcataaaattgcgatgaacagccgtcgcgaaaaacgagcggaacaaaagcgccatgccgtcaacgagcagtaatttgttattcatatatcgaaactcctttttttattcaatgttcctattttaccaaagaaggcggtaaaaaaacagcatccccccatttggaagatgctgccgtcacgttactcaccgtgtcttttattgcttgccatcagcttttcagcttcacggccggcataggaatcaaatttctgtccgaagccgtttttctttttggcattgttattctgctgagcatttctgtttcccagttttgttctgcccatggtcatatccccctttagagaagatacggatagtatgtacagcaagcgctgatgacacacgcggcaggttcatccattactgtctgctgacgaattctttcaccatctcttcacttacgaatcgtctttgcggcacgatgccctttttcgccagctggttcatttttgcggtgatgccattaatggcatctgtcgtgaacggttcattctgtctgcattttacaatggcttcttcaatggcctgttcacgctcatagtcaagctgtacaaatgttttgacgtgctgatgctgttttgcggaatgtgctgaaattgctttatggacttctgacataaaaggtttcatctcgcttttttcattttagtctaccacgactgttatctgcccgccaaccggatttttaaattttcagcatttcatctttctttttccatgctttttcggcctcgtaaaggtgttcaatttcccttgcactcgtattttccgccgcaagaccttgtaaataagtgtcccgctgctcgcggatctgggacaggcttttatccgccatgtcttcttgcagacggcgcacctgctcagtatatcgctctgaaaggctttctttctcctgctcaagccacttttctgtcactttttgcaggctgagcctgagcccttccacaaacgctgcttttccgttctgttcaaaaaactgcttcggcgatttaacttcttttatgtgatgtgtgaatgccgagacgtcaatgaccggagcgacctctttcagctgaacggcaaattcgttttcggcgctcacataaatagagaaatctccgtcttccataagcttcttctgacagttttccatccattcctcagtcatatgacgctcaataaaaccggtcatccggatatcgagcgttttcagctcttgaatatattcaaaacggaattccttgagcgcttcattcagcgccgctgatatattttgtttccaatcaccgttttgaagacccggatggaaggcggttttcagcatatcattcgcataaaacgtcaggcgatgtttaatgtgatagagctgctcttccgtatctttcatcacttttcgaatgatgacctcagacgtacggcgctttgaaatgtcagcgagagctttttcataggaagactccagacgctgtttctttttctctttttcttctgccgactggtgaagagattcgtgaagctgttccaccatatcgcacaatttgtcggcctctgttttcagctgggcgcagcttgccctcattacatcttcctcaataaagtgctcaagcccggttcttacatcagagaacctgttataaaaagctgcttttttacccgcaagctcttctttacttgagacatgatataatttcggccggttaattccctcttttgagagttctgagcggacatagtctttgacggtttccagctcgctttcggttttggccagatctgcggcgttaatgacaaaaaacattttatccatgccgaatgattctttgacgaggccgagtttcttcagaaaagacctgtctccttttgaaaaagaatgctgatagtacgtcatataaaagaacgcgtcagcatcttttatatattgaaaggcaagttccgtatggcgcttgtttatactgcttgctcccggcgtatcaacaatggtgatgcctttttgcgtgagaggcgaatcataatacacggtgacttcttttacgcagcaggccgttttttcttccgctgcatacggttttaaatcttcaaccggcaccgtcagtgtcagcctttgacggatctgttcttcatacgtatcaaacgcctgcagcatcgtctgaatcaccgggataagttcatccggaacttttccctttttaatggcataattccatctctctttcagtgaacgtccctttacatcagcgtctttcagctcagtcagctgaagcatttcagcgtccagctcctcctccgttttaaaaacgatctccgcagatttatgcggtttgccgtcttgcggtttcgttattttgttgatcgtagccgttgtgggcgtcggtgatgacggaagcacgtattcaccgacaagcgcatttgcaaatgatgatttaccggaactgaatccgccgaataacgccaaggtaaactggcggtttccaagccgctcaatcctgcttcgaaaggcttctgcctgttttcctaatatgctcgaggattcaagaatcccagcaagctcatagaatcgatcagtctgctcttttatagaaagttccttcatcgcatttttttcgggcttgtttacttcatactgtacagtctcttttggtttctctatttggacgggcgcgtttgcaagacgtttttttcgcgtataccagtcgccgcttccagtatcacaggtcaattcttcttcccacaaagcgcggactcgggctgctttttccaaggcattgcgttcttcttttgccgattgcgcgagctcatcccttatcttcttttctttttcgagccgttttttcaagttctcaatgagcggtccgttttttgcctgaacataagcggtcagctcctcaatgagttccgctgtttgtcttttggcttcccttctgatcatctcagcgaggtctttcgtataagttaatacgtattcagatgaaaaggccgctccctgcttaatggcctgagcggtgatatcatcagaaagcggtgtgcggtacgcctggattttcttgatcagttcgtccgaatccgcttcataccgcttggccgctttcgtaaatgtgtcgataatatgccaatccgcttccccttccgttctttttttaatatcggcaaaaaattcagcatgccttctctctttctcctgagccgttttcgcttttgaaaagaataatccggttttaaatgagggctgctgtgattcaatataagcagatgcaagctccctcatctcaaaaggtgtcagattagcgttctgcaatatgttctgcacgtcttttctgatgtctttctctgctgtttcagcctgttgaaccgcttttttaagctcatcttcaacagaacggacaagtgcttcttgtttgtcaaactgctctccgctgccgtttttatcttcttttacgagcatctctgtatgctctttgactaagtgtgcgacttttctctccgttaaggaccataaatttgattttgcctgctgtttcagcttctgcagatgttttttcagctgttccatgccgtttaaaggatggtcaggctcagtgacagacgtaaagaaaagcgattctttcggtattcccgcgccttcaagcatatcttccacctgcctgcggtactcttcaaacttcgtttcggtttcatcatgcctgtcaatttggttgacgatcagaaacaaattcggaatacggtctttgatggagctgagaaacagcatattttcttctgaatgaacgtgattataatgaacgacgtaaaataaagcgtcagcctgatggagaaccgaagcggcagataaaaaatgcgcttcgtccgtcgaatcaattcccggtgtgtcaatgtaggccgcataaggctctgactccttaaagccggcatagacttccaccgtttcaatttgctcaccgtctttacagaattgctgcacttgttttttatcgtaacttcctttaatttcagcataagccccgtccgtcgtatgaagcacgactttatcttcaccgtgccggatgacaacgaggttggcgcttgtgggaatcgggcttgtcggcagtatgtcttcaccgagcaatgtgtttaataaagaggactttccggccgaataatgcccggtaaacgcgatataaacctcttcatcagccgcttttttcataatggctgcgagctgatcggcccgtttttcatcttgatgatctaaaaattgtgcgtataaggcacccgttctgctgaaaatctccctgttatggcgttcttcttctgtcatgtgtctttacccctttgtgtctgtcgcatcaaatgacgttttcatttttagaaagctctgaaaaaaacctctcccccattttacacaagaatggcccacttttcttcaggaaacgtaaaaaagccgccgatatcggcagctgataaagaaaaaacacccgcggcattaaaaaccgcagatgtttaagaagacatcgatttattcgaaacttttttcaatacgaaaccaattaaaacactgtatgtacaaacggctgcaaataaaaataacattgtcattttcggcaccaccttgaatgagaatcattttcatatttacatcttatcatgagtgagaatgattttcaatctctattttgcggtgttttcttctagcgctttctcttcggcgcgaatcctcacagtgagcatgcaggcattgagaatcgaaaagagaaatagtgtccaatacgctccgtataacagcggcagaaaaataaattctaagatgacgaccatgtagttcgggtgtttcatccacctgtacggcccctttctgacaagctccgcatccggcacgacaagaattttcgtattccaataccgccctaatgataatagagcccaatacctgatcccctgtacaaataaaataatacatataatggcggcccaccttggagaaagcgttttttgaaacgccgccacctcagctgtaagagagacaaaaaagagcacgtgcatcaggacgagaaagggataatgtccttctccgtattcgactgcgccttgctctttcaccttttgctcattgcgccgggccacgatcatctccgcaatccgctgggccgcaagcagcatgataaacagccaaaacattaagaagcccccttttcccagctgaacagcaaaagctcagacgaaaatcccggcccgagagcgccgatcagccctttttcgttttctttctgccggccgcggagcaactgttcttttatcacgtgaaaaatagttgcggaagacatgttgccgtgtttttgcagcaccttccgagatgccgcaagatgaccggagtccattgaaagactcgttaaataggcgtcaatgacctttttcccgcctggatgggcaagaaaggttttaatgtcgtgaggatcgacaccatattctaataaaaattcatcaacattgtccttcagccactgtgaaaccagggtgggaatatctcttgaaaaaatgacttgaaaaccgctgtcggtgaattcccagcccatcacatcttccgcatccgacatcatcaccgattgagtggcaaatatccgcggaagaagcggctgtttgacgtcgtttcggttcgccttttcccctccgattagtactgcggcaattccgtccgcaaacagggaagttccgattaagttgctttttgacttgtcgttcggctgaaacgttaagctgcagagttcagccgcgatgacaagcacgtatgcttcaggatatgcgcggcagtattcgtacgccctggacaggccggccgctccgcccgcgcatcctaagccccagatcggtatccgttttgttttcgcagaaaacggcagctgattcatcactttcgcttcaatgctgggtgtcgaaagcccggtgctggaaataaaaaagatcgcatccactttttcatatgggaagggatttgttaaacaatccgggtttgttaaacaatcaagcgccgcatccgcactatgcttaacggtttcttccgtatacagccggttcttttctgaaaaaccccgcgccgttttataccattcaatcggccggacaaactgccttgattcaatttcgccgttttgaaaggcttttaacagccgatcaatatccttaaatgaatcggcaaacatccctctcgcaaaatctgccgccgtttcttgcgagacatgatacttcggaatgctcgttccgaccgacaacacatatgccatgcccatcacctcttcacataaaggtttccgcttttttcctgaatgtatgcataagtttgaatcgaggatttcactgacatgccattttaatttaaaattggcccttttgaatgataaaccgttcgactatacttgacccattcataaaaaaaggttgtgataagcatgctgaaacccgtcattcttaaagggtcactcgttcagttagagccgatgacgattgatcactctcaggcactttgtgaagctgcttcagaaaataggacgacttacgcttacacccatgttcctgacggaatcgaagaaacaaagcgttatattgaacgtgcgctttccgattatgaaaaaggacttgcattgccatttgcagtacggagtcttgaaacagaccgaatcgtcggaagcacgcggtttatggatgcggaagtgtttacgcggccggcggacgcagccccggaagtgtgtgagatcggcagcacatggtatgcctctgccgtacagcggaccggtgtcaatacggaatgtaaacttctgttgctgacccatgcgtttgacgcgtggcaagctgtcagggtgacgttgaaaaccgatgttcgcaaccagcgctcatgaactgcgattttgcggatcggtgcccaatttgaaggaatccgccgcgcgcatattccggctgtcgacggcggcctcagagataccgcctactactccatccttcgggcggaatggccttatatccggcaaaacctttctggccggcttgcagcatataactgaaaaacctgccgatatatacggcaggttttttacatattcggatcatggacgtataaattgagatcgatccgtccgtctgaggtgaccgctaccccctcagcttcaagagacagcttctgtacagaaaacatctcttcatctcttaatccgatttcaccctttgcattgatgaccctgtgccaaggaagacgatgctttttactcatggagtgaagaatcctcacaacctgcctcgctccctgcggacttcccgcaagaccggcaatttgaccatacgtcatcacttttccttcaggaatctgtttgataatggctaccgcccgttccgtaaatgtcatgtaactcctcatttcgcaagagcagatgattttcgagaaaatcagccacttcctgttcttatttttatagatgataattgcttcatcatcatacttattacatctctgcgtttaaatagattatctgtttgttcacaaaaaattaacaaagataggcatgtacatgtttaacataatatgtaataatacaattgtattaaaaaagaaaaggagtgtttgcaatgaaaatgaaaaaagctttagccggctcagccctatcactcgctttactctgttctgccgcccctgcttttgccgcaggtcctgctgatacaccttctgcagaaagcaaaacgaaggaagtatctgctttggcgacgttcatacttaatggttctggccctgattatcctacttcaatttaccagaatggaatcacctattatttagacaacatcaccttccatggtgctgatggcacttggacagccgtctacaaaagctgatttttcatgacggcggaatgattgtcttaagtaacaactaaaaagctgctaatataagggggctttgcccctttttttagtttcactgccttttataattgatccagcatatagcacctaggtgcgtaatttcatttcacccgatgatcattatcagtcgtactgttttctgcttttagacgcaaaaacacataatctaaaattctctcccgcgtgtctatccaaaagccgagtctcaactctatcaatccggaacattttatcgacgcctgagttccccagctaacgttaagaaacctcttacttgctcttttatttttgataaaacaccatccagggtgataacatgagatttgcttgggaagaattaattataattgcattcggaatgattttactgagaatttcagggagaaaatccattgcacaaatgaccatcgcacagacaatggtgatgatttcaatcggtacgattatcgttcaccccattttagaaactagtttattgaaaacattaatcactgcgtctatccttttagtgctttaattttgatggaatggtttcaagtaaaagtaaactggattgaattttttttaacccgaaaatctaaattcgatatagaagacggccaactcaatatagaaaacttaaagaagctgagactgacagcagatcaactcgaaatgcgtctaaggcttcttggcatttcaaaaataaacacaattaaatatgccactttagaagctaatggacaattaggctacgaattaaaagatgactgtaagcctttaaccatcaaagatcttaaaaatgtgatcgatccaaaattccttaacaatgagtctccatctcaaacagagggtcaagccaatctatttgaggaaatcaaaagacatcagactcagcacaagccaaaaaatcttgaataattcgctgattagtaaaaccttttgttattcaaaaccgaagccggatccagaccgttaaccgccgatcattttttaccgaaatcggtttataagaaacaaaaaagcatctgaagcagatgccttttttccgacgaggtccttgtatgcgcctgaatatgcttttcagccgcctatacccaccgtcggccttagccataatgttaatcagtttgtttttataaaatcattgattaattgatcagtcgttaatattgtggcaaattcatcatgcaatgtagccagagatatattgtgaatagtctctgcatcataatatgtatcattttggtctctcatcccgaaggctgctgttgcatctgaaatcaggtaggtatcaaatcctaaattaccgctcattcttgtagttgttgaaacacaatggggcgtagtcaaaccagttattacgacagttgttatatcatttgattttaaaatctcttctagattagtcccgataaagctgctgtttactttcttggttataatgacttctttatccataggtttaacgatttcctttatagcaaccccctcattttttggataaaataaagaaccaggtttatcagaaatatgttgtatgtatatgactgtccatcctttttctctccataatttcagtattttactaatattttcttccgcttttacgttatttcgttctccccattttttatcatcgaaagctatttgtacatccacaatgattaacgcttttttcttttctgccaccagataacctcctatattgaaaattagtatttataacattttaaataaagtttttacttttgtacaattgtttcagttttaaatttcatatcacacctttcccgttggaaaagcgctggaatagctaaagcaaacactcactcaaaggctgcagttcaccagaggccagcaataatcaactctttttctctatatacttatcagtatcccttttgccatccactcccctaacaaaattcacgctacgctcacaaaatattaacaaaaaaccccttggttatttttgtatttcatgtaataatacaagtgtattaaaaacaaaggagtgtttaaaatgaaattaaaaaaagttttaactggttctgccttgtctctcactttactcgtttccgctgcccctgcttttgcatccagccctggcaatacaaatagcgactcaactcaaacaaaattttcgacacaagcgaccaaagattcttttacaatggattaccttcatagatgggatatcccaaatacaactgttaaaaatggtgttacttattaccttaagaaagtagagataatcgaagggttctatcgcgcaacttttgaaggatggattaattagaagaaggggctttcccttcttttactctcttttgtaaggatcggtgcacaagacactccccctcagtgcccatcctgcagtttcatttcggcatcaggcatttcattccatgtctcaaccaagtttcgtgtcatcacagtgcgagcaatgatattgtttacgatatgatcccccattctccttttttttcttacatttagtcatatgttcacgtacatatagttcgggacggtttttcggcgaaataaggcggatgccgcatcactcaatttgttttttttcaaacaatgaaactattaaaaaaagaggatgcctcgcaaaaagttcagcaactttcggaagcatcctcgatctggataaaataagatgttattttaaagaaaacggatcactaaccctcttgaacccttgtcacatcaagggtttttttcgttttaggaatcatattataaactatattcaaaagcacggcggtaaagcttccggcgacgattccgtttgtggtcagcaaatttaagtaagacggcaggtgcttaaacatatcgggaacgacagttacaccgagtcccaatccgaccgaacacgcgacgatcagaaggttttcctgctttttaaagtcaatttgactgagcattttaatgccgtaggaaatgaccatgccgaacatggccaccatcgcgccgcccagtactgaagacgggatgatggtcgtgaaggctgcgattttcggaaaaaggccgaagagcattaaaagtgcgcccgtgacaccgatgaccgcgtttttcttaatccccgtcagctgcacgagaccgacgttttgggaataggccgtatacggaaaagcattgaaaatgccgctgatgaataccgccagaccttccgcgcggtagccttttgctaaatcacgttcagacaggcgccggtttgtcaggtcaccgagagcgaaatagacgccggttgactcaacaaggctgacaatggcaacgatggacatcgtaataatcggtgccgcatgaaatgtcggcgtcccgaagtaaaacggtttaatcatttgaatggcgtcagcattcgccacattgtcaaattgcacttttcccataaaataagcgatggccgtcccgatgacaatgccgattaaaatcgaaatggatttcaaaaatccttttgtaaaccgataaagcagcacgataatgacgagcaccgtaaatccgagggcaaggttagccggatcaccgaaatccttgctgccttccccgccggcaatatgattcatcgcgaccggcattaaggtcatcccgataatcgtcacgacagatccggttacgacaggcggaaaaaaggatacgagcttgccgaagaaaaatgacagcagaatgacaagcagacccgatgccaaaatgcttccgtaaatggctgaaatcccgtactccttaccgatggaaataatcggcgctaccgcggtgaacgtacagccgagcacaacaggcaagccgatgccgaaacatttattcctccatacttgaagcagcgtagcagccccgcacataaaaatgtcaattgatacgagatatgtcagctgttctgcgttcagtcccaatgccgctcctacaattaaaggaacaacgacggcgccggcatacatggcaagcacatgctggataccgagggaaagtgttttggcatagccgtttttcataaacggacctcctgtacaaatgtcacttttccgtcttcaagcgattgaattctcgccagtgattcgacccggcatccttttttcaccagctcgtctcttcccggctgaaatgacttttcaatgacgattccgatcccgcaaaccgctgcgcctgcttgttttacgatggacaaaagcccctctgccgcctgtccgttcgctaaaaagtcgtcaatgattaacacgcggtcttctttcgagagatgatttccggagattgcaatctgactttctgtttttttcgtgaaagaatagacggacgccgtcagcagatcatccgttaacgtgagagacttcctttttctcgcaaagatgacgggaacgccgagttcaagaccggccattaccgcaggggcaatgcccgaagattcaattgtgacgattttggttatctcgtctttttcaaaacggctcgcaaattcccggccgatctgctgcatgagaaccggatcaatttgatggtttaaaaaagaatccactttcagcacttgatcagaaagaacgattccgtcttctgctatttttcgttttaatgcttccacaatgattacccccgcttataaaaaataaaaaaagcattgcccgctctccaaaaaaagagcaagcaatgccgaatgatctacacgtaacggccgaataaagccgtcccattgctcactcatagtcggacatttacggtgaccggtagaaacttgcgtgccatatccacgcgattatatgagtgttcgtatgatattaatcaaattataacaagatacacttcttttgcatagtgaaatttgaatattcccgaacttttacaaagaattagttttcgattattcgtctttttagaatttttagaaaaacgcccggtgtatgccgggcgtttcgtttataaatataaatttgaatatttgccgacgagatactcaatgagatattgaacgttcaattcttctcccgttgcatcttttatgatatcaagcggcattttgcgtcttccgtgctgatgaaccttttctgtcagccattgtttgatcggctcaaagtcgccccgttctattaattgatcaaattcaggcagatcctcaagcatggtatgcttcagctgtgccgcatacatatatccgagcgcataggaagggaaatagccgaaatcgccgcccgcccaatgtacgtcctgcaaaatgccttttgcgtcagatggcggcgtaatgcctaaataatcatgatatttttgattccacaatgccggcagttcttccactgtcacttcattgctgaaaatcgctttttcaatttcataacggataataatatgaagcggatatgtcagctcatcggcttcaattcggataaaggacggtttcgcctcgtttacggcgcgtacaaaatcctctctttttacattttgaaattgatcaggtgaagcctcaaccattttttcataataggcggtccagaattgttgatttctgccgataaagttttcataaaataacgattgggattcatgaattcccatggatgcaccgtcagataagttcgttccgctcagggcttcgtcaatattctgctcgtagatcgcatgcccgcattcatgaatcgttccgaaaatcgccgtgcggaaatcgttttcgtcatatctggtcgtcacccgcacatcgccgcggttgatcgtcgtcataaacggatgaaccgtttcgtccaggcggccgccgtcaaactcatacccaagttcttttaagaaatacaaggagagatctctttgtttttctttcggaaacgttttcgttataaaggaagtgtccggtttatttccggatgtcgtcacttttttgacaagcggaatgatcgcttccttcaattcagaaaacagctgatccagcacctttaccgtaacgcccggttcgaaaatatcgagcaatgcgttgtatggatgatcttcatagccccaatacgaaataaaccgcttattaaaatcaatcagcttctcaaggtacggagcaaacatagagaaatcagaggctgcccttgcctcctcccaagccgtttccgctttcgatgtcaaaatgacatattctctatactcatcttcaggtatttttttattatgatcataatctttttttgcaagttccgcagctttcactgtatcttcagagagctcttctgcatgcgcgagaaggatgtcaatcagctctttcatccggtcggatgtctggatttgaaaaacgtcagccgacagctgcccgatgctttccgcccggtcatcagaaccttttttcggggctcccgttcttgagtcccaatgcatgagcgcaatggcttcttcatagtgggatactctttttaacagatcaaaaaactctttttcatatgtatgtaaatccatatccgttcccctcccttttcactatcaattacaggctaatggaacgccgtcataaagtcaacttcccggatttaaaaaagccgcaggataagattcctgcagcttttgtttttatatgattttcggtgtaacaggcaagacctttttgacttcggccaggacccgttcactttctccgcccgcataaatggatatggttccgctgtcctgattagaacggatgaggcggccgattccctgccggactctcaaaagcatgtacggcagatcaacttcctcgaacggatcttttttcgctccgtttcgctttgcggtaaacacaggatcatgaggcggatacggcaatgcccaaatggtcacattccggagcgagtcaccgggaatgtcaagaccttcccataagtggacggaacaaagcacggattcttcatcccgctggaatttttcgaccagactgctgatctcttcgtcaccttcgtagtaaatcggatacggcagctcccacgcggcagcctgttctttaaattccttcatgtcttcaaaggaagggaaaagaacgagagtgcgtccttcattctccttaatggtttcaatcgtttcggctgttttctgctcagacgtcatgtcaccgtgaagcgaaacagacatttgctcctcgtaatcgtacggagattcaacggtaaatgataaaggatcacggattccgagactgtcagcgatataatcaaatgaaccgccctcagaaagagtggccgatgagaagatataaggaatctttttagaaaagaccttttctcccaaaacttcggctacagttctcggcataacgacaaacgttgagtctgtatcccgcgtttcaagccagctgatggcatccttttgatacagcgacagcgaatatgccatttgttcgacgtattcttctacgactgacagctcgtacttatcgatcgtatacatttccgattcaaatacgagcgcctcgccgattttatcgagcagacggcacagttcgtcagccgcacgcttaacacgctggtcgttttggatgtccaatcggtgagagccggcgatttccttcgattcctctgacagcacatagaaaaactcatcgtttgcggcaagggcatcttcaatcagttcggcgaattcctctctgatgtcattttgaagcagacgctctaaaaacagctcgagcgtcgactgcttcacacgatacgttaacgctttttgcgcggcgaattccagcagatgtccttcatcaaacacgacggcgctgtgatccggcaaaagcggcagctgcccttcccttttgcgtgattcttccgtccatacatgctccatgtagaaatcatgggagcaaacaatcagatccgttgattttctgtaatgatctcttgaaagtgttaaaccgcatctatgtctcatatcacatgttaaacaatcttggaaggaatcatagctgacgcctgcccactcttcatttgtcaaatcagcgtactgtttgcggtcgccgtacggataaaagcgctgcatcgcttgtgattcgtgtacgaatgaaggcagcgactcataaagatccagccacttttcatcatcagaacgctgcatcgttttctcaagctttttcagacacagatactgctcatgggatttggacagccgtgtatcaatctgcagatccaaatgttctgtcagcttggaaatgtcgccttcttttttgacaagctgttctattaacgtttcatcggcgcatgcgataatggccggtttacccgtatatctggcatagctgatggcaaacagcagatacaccagcgttttccccgtaccgactcctgcctcagcgaacatgacctttttctctttaaaagcccgttcaagctgaaacgccataaatacctgctcatcccgaaggtcaaagcctttctcgggaaggatatcgtaaaacacgtcaccaatccaattgttcaattcttcgtaaaaattcttttcttttgttaaagcaaaaggcaaacgtgatgttgtcacccaactccaacccctaactattcggcattcagaccatctataatatcatttaacccttttcaatacaacaaaaaaacttggccacgccaagtttttgtcattactcatttccggttaatgatatgtgtacataggaacggatggtctgttgaatgtgtatgttttaccgcattttcaagttcttcctgtgcgtgtgtcatggcggaaggaccgaactccgctccggcttcctccagccggaaagcagttgcatctaacgccttttgtattttactgaagtgctcgctgttcagcataaaataagatcacctctcaaatagaaataatcatcattctatgccgatgcttcactttctatacatgccatcctgaatgatccgcacctgacctgcacaaactacaacagatattcgatcgaatatccatcttcacaaaattattctatccgggagtgatggttacatgagttataaagatcgattagatcagcattctgaattgtttcatcacaattggacgcggccgaaacgctctaaatcgcaggtgaacggccacaccgaaatgtcccagaccaacattattttacggagcaacgcaaaagcgcaccgctggtaatggcagaataaaacgtaaagatgccggagaagacgctgtttcaggcgtcttctctttgttacggctttttccgctgcggccgcactttagcccagtactgataataatccgttttgataaaaccgttaaagagcttccgtttttttgttgcttttcttccgtagacctcttcaaattgttcatttgacgttaacatgtagacagaccatgtatcaagagattcaaatgcccggcccatttctttatacatctgctcgacttcctttttttcgccgagccgttcgccgtacggagggtttccgacgataacgccgaattcgagtttcgtcgtaaaatcctgcactcgcatctgcttgcattcgatcaggtccccaagtcccgcttcttctgcattttctttggcgatgtttaccatccggtgatctacgtcactggcaaagatctgcagcggctgatcatagttcgccttttcttccacttcaaggcgcgccttgtcccatagttcttttccgatccattcccagtcttctgaagcaaaatcacggttaaaacccggagcaatgttttgcccgattaaagcggcttcgatggcgatcgtgccggaaccgcagaacggatcgacgaacggacggtcaggcgtccagttggttaacagaattaacgcggcagcgagcgtttctttaatcggagctccgccctgatcaaccctgtatccccgtttgtgaaggcctgttcctgatgaatccagcgtaagcaccgctttatcttttaaaagggaaatctctaccttatactcgggtcccgtttcttcaatccattcattttgttttcctgattgaagtttcagcttttccgctatcgcctttttgacgatccgctggcagtcgggcacactggcaagcactgatttcacggactttccgataacggggaactttgcgttttcgggaatgtacgcgcgccagtcaatcgcttttgttttttcaaacagctcatcaaacgtttttgcctgaaactcggcgacctgtactttaatgcggtcagccgtccgcagccataagttagcgcggcagatcgcaagcgcatctccttcaaaaatgacttttccgttgtctactttgcattcataacctaaatcacgcacttctttggcgacgatcgcttcaattcccatcggcgccgtcgctattagtgtgtacttcttcatcgtatcaccctgtctcttttaagctttcgtttcattcaagataaaagctcccctttaaaggagagctctaatttgtcatatcaataatgtttaacgttctgtaagccatgttttgttccgtcgtactgcaatcggctcatcacctcgtactcaggcggcaatcatctatctacagaaagtattctgtccttctatctgttcagttccttcaagaaggttcccctaccaaaatttgggtttctcgctcgaggggtttaccgcgttccactctcaccatttctgatgagacttcgtcactgtggcactttcaaggatactcagccatatccggagacgtaggcttttttcctgccgtcagcctatcaaggctgccctagcttatttcttcgctaggcacgaacactacgggcatctcagcaccgtgcgagcatggactttcctctacagattcaaagatctgcagcgattacccgaacgttaagaacacttgttcattataaagcaacttgtctcatttgacaagtgcatctgccttattcgtcataaagtttgctgccgaatacatgtttctcaaggttggacagccttttcagaatgtcaaagttggtcgtattggactgcaccggctgttttttgcttgcttcttcaagctgttttttcagctgcagattttcctgctgcagttcttcaatttcttgatgaaaggtttcataatccttaataatcatatctaaaaatttgtcaacgtcttcttgtctgtaacctctaacgcctgttttaaattctttttccaaaatgtctttcgcagaaagctttactttatcagcaagcatctttttcacctcatatcgtgaatcatcatgttatattttattcagaaacacgtcccgttgtcaaatattctctgacgtgttatgtaaagaaatcttcttcttcaacggcggcacggagatcatccatcgtaatcgaataaatcggatatccgtcggtttcacggcgtttttctgcctgctgcagcatatatttcggcgacccttccacctccggatcatataaaagcaaaagcgcatctgacttttcaataaagaacgcgtttttctgccggaattggagcggactttcgtacggccgatgcgtcaggctctcctcataatctgcctgagcaagcaccgcttcatacatttctttattcggctccttccacttttcctcctggccgtagaaaggcgtgataacggcaacctttaattccggatactcttctctgagatcgtacgccgtttctgccgcccaaagctcagtccccagctgtccggatatgagaatccattccaagccttcgtcaataaagcttctgagtctggtttctatcgccttttttatataaacaagcgcccggtcatcccgtttaaaaatcccgagttcaaacggcttgtaccccgttacggctaatactttcaattgatcacctgcttaaaaaatggggctccccatcgggccccattttgatttgctgatatcctaaccgatcttgcttaagcattcaatactaatgatcgcagcaagggcttccgcactgaaaatgctggtgagttgtcgggtcaacatttgaaaaagtgtgcggatagtaatgaacgtgctcaaagttgtggtgatttacgttagttgtatgttgcggatgaatatgcggcacaaccgtgttagaaaagcaatggtgttcacagcaatgagtcggatggacaatcggcggcatcacgtttggtctgcaacaatgatgatgaaacatgctaaatcccctctccattaacttttattacactgttaggttatgaagaaaagagggtgcatgttctaattcaatcacccaatttaaaagtgcgtcagcaagctgtctttaaaattcgaaaatacaaacgcaatcaaaaaaaccacgacaaagaacaagtaaaaaacacctttatacataccaactctcccctataaataactaacgctattttacaagatgcggcaccattctacaacaaaatcgatgcggattcagaaaaaaatatttttggcgaaacagctcggcttttgcgctttcccgggcaatattttaagaggaatatttcctcttgagccgggcaattcttacatggagcttctcggcttctttttccgatatttccccgtcttctgctgcctgctgtgcggcctgcagagcttttttgtaatcttttgcatgatgctcaaaatagatcgccagctcaaccgctgattggtgtctgcatgtgtgaagatcagagcccgtcagtttctcccaaagggacacggcgtcttgcctgcggttttgttttttataaagcatcgctaagtcaaaaagggcccgatccgaatctttaaagtctttgccttgcagcgcttccagctgcgaaacggcgcgatcggtttctttatgagcgataaaccatttcgccatggcgtatgcttcctgacgttctgacgtctgatcagaagatgcaaaaatcttttttgacatatggatgtaaagagcgatgagggaaagcacatcttgttcattatgcgagagcactccctttaaaagagccgggtcctccgcctttaaaaattgaaaatacagcatcggcgccaaataaccaggggtgtcttcgtcccttttaaaagcaagctcttcattttcaaccgccgaaagcgatacacgctctaatttatgtttccaaagccgtctcgccccgtgcagaagatcaaagtgcccgaagtcaggaagtttcggaagcctgtcccgcagcaatgtatgcctggtttttacctgcggccagtcaaaggcttttccgttatacgtaacaagggacgtaatgtcaacctcacttaaaaagcttttgtaaagagctgtctcgtttcccggtttagggagcagatgctgtttaaccgcgacacggtcttcatacactcttgcatggccgagcaaaaagatcatattgccggccccgccgccgaggccggtcgtttcagtatcaaagaagaacagctggcttttttcgtatccttctgctgataaagtatgtgtcaaaccgcctttattccataatgccatgacgtcatcaagttcactgaagctgtaccgtccgtggcggtgcgaaagcggatagacggtttcgcggataagacagtattcatcctcaaaaaagaaaggcttcactccgaatgcctcccattcttctctaaacgggacttgaatatccgggaccgaaagttgtgaagctgccggctttttttcagcttccggcacattcaggtggtttttcatccgctttaatttatttttcaaggacatctttcgtcccccttttcttttacacgtaattcaagagcttgagtatcgctttctttgcatctattccttctatttcggagccgatgcaggaaggacatccgtcttgacatggacattgtctgatcaggcgctcagccccttcattgatttcatcaaatcgcttatatacttcatcggcaagtccgattccgcccggataatgatcatacagaaagattgtcggaagtcccgtatgtgcggctttgatttgcggcacgacatgcacgtcatttcggtcgcacatgacgtatacaggcacgatatgctgcaggacgtgggcaatgcctaaaagcagctgttcaagtgttttttcgccgatctccgaatccgtttcttttaattcaagccaggctgcactggtatgcagttcttcttcaggaagatgaatcggtcctgatcctatattttcaaatgtcgtcattttaatttttttaaatattgtcggaagtgcgttcacggtgacgtcgccgaaatgtaaggccgttttctttctgctgtccgttctgtcaatgtccagcactttcagctgcaccgctaaattggcatctgtataatattcgacatcgacctttcgcacgtacgcttttttatgatcccaatcaagcttttcaacctgatactgcaccccttcatgaagataaatcgcttcatcatgaagaagcgtcatcgcgctgaagcggtccatttctccgatgatttttacatcagccgtctctgagcggtcaacgatgaccacgttttcctgtgacgctgaacggagactgatgttggaggcgggaaaagattcgctcgcccagtgatagcgttcgcggttttcgtgaagcaccccttcttcctctaaatactcgagaatgtctctcgcatcattttctccgaatgtttcatcggctctgaaaggcagctcatacgcggcgcatttcaggtgatcgactaatataatgagattatcaggattaatccttgcagattcaggcgagcgtttaaagaaataatcaggatggcggacaatatattggtcaatcggatcagagttcgccaccatcacgataagcgcctcaccctgccgccgtccggcccggcccgcctgctgccatgcgctcgcgacactgcccgggtaccccgtcatcacgcagacctgaagctggccgatatcaacgccgagctccagcgcgtttgtgctgacaacgccgagaatgctgccgtctcttaacccccgctctatttctcttctttctttcggaagataaccgccgcgatagcctctgacagacttcgagccgatttctttttttacgatctcctgaatgtggcttaaaataatttcgacccggacacggcttctggcaaaaacaatcgtctggatcttattttttaaaaaagttttggcaagttcgttcacttccacggtggcgctttttcgaatatgcagcggtttatttacaatcggaggattgtaaaaagcaaagtgctttcttcctgccggggcaccgttgtcgtcaatcaggcgcacggatttccccgtcagctgctccgccaactccctcggattggcgattgtggcggatgtacagataaatgacggcgtgcttccgtaaaaagcgcagattctcattaaacggcggatgacgttcgccacatggctgccgaatacaccgcggtacgtatgtaattcatcaatgacgatatatttcaggttttcaaacagactcacccattttgtatggtggggaagaatggctgaatgaagcatatcgggatttgtgatcacaatatgcccggcctttctgactttctgcctgatagccggagacgtatctccgtcataggtgaagcttttaatatccatgcccgtctcgtctatgatttcattcagctcgcttttttgatcctgcgcgagcgcctttgtcggaaataaataaagtgcgcggcttgaggcatcttccgcgatagactgaagaaccggaagattatagcacagtgtttttccggaggccgtcggtgtgacggccacaatgctttctccgttttgaaccgtctgaaaagcggagtattgatgtgtaaaaagccgctcgatccccctcttttcgagagccgcccgaatgttcggatctacttgctccggcatcggcatggttttcgcctcccgcggttcctcttcatgccaatgcacaatattttcatgattttttaattcctgaatcagttcgctcagtgattttttcttcatcgttcacacctctttatgaggtacagtttaccgaatatttgtttgcctggctagatgaaaatcctgcacaagaaaaaaagcagggaatcagcccctgcctacttcatttttatcgtaaaaagctctgtttgtccttttttcgcttcatttgcgcctgcaaattgcaaaggttctgcggcatcgccattcataatcaccatagggatgacggtgctgcttgctttttcttttattaaatccagccggcacgttaaaagcagatcgcctgttttcactttgtctccttcttttacatgcgcttcaaagccttcgccgttcatattgacggtatccaaaccgacatgtatcaaaagttccgctccggaaagggtgcggatgccgacagcgtgttttgtatggaacagctgaatcacttctccctcaaccggtgaaacaatgtctccgtttgcaggctcgacggcgatcccgtcccccatcattttttgtgaaaatacaggatccggcactgaagccaaatccatcaccgctccgtcagccggagaaaaaatcacttcctcggccggctttttccggctgtctcccaatccgaataattttttcagcaatgtgttgtgctccccttcctaaatgtgaatccgttaccagtttattctccactatttaaccatactttcttttttccttcaattcttaaccatacggcatagcatcgcatagtctgtttgtaaaaaggcggtggtcatatggatcaatcacaaaacgataaacttgatccgcaaagtaatgaggacatcatcagccatgcgatggaccaattttttcactcaggtcccttcgcagaattgatgcagggttttcagcaccttgtcaattcggcttttactgaagcgcaagtgacgattgacgtcagagaagagccgacggggctcgcggttgatatcggcgttcccgagacgttccgtgacggggatatgctggtggaaacgaaagggtgctaccttcacgttacaatccgctacgatcataaacaggctcaatcatcccatgtgtcttcaagcatgacaagaaccgttgtcctcccgtataaggtaagtgaagaagatatggaaacatcctggaatgaacagacgcttaccctctttttccctaaaaaataagcatgaatgatgaatatcattcatgctttttatttgaagatactggtgaagcctttcaccagcgatccgacctgatttacggcgcttaccatctgccccgttgtatccatcattttattaaagtcaaactgtccgttcgtttttttaaactgggagagtatgcctgagaattgggaagactgctgctgattcggtctgggaacggggtaaggattcacaaactccggctggcccccgggcatgcctgcctgaggaggagcaggagcatacggcggctgcatatgaccgtattcctgattcggataaaattgctgcgggtactgcccttgctgatgatatggcggctgctgcaatggctgtatctgctgcgggtagaaatatcccgccggctgctggtacatattttgatatggctgcgctctccattgcatatgacattcccccttgtctcttactaagtttctactatatatgtatgaattccgccttggttatgtgctttcggtgattctgatctttgtcaaatgctgtcgaaagtcttaattttttaaaaacagaaaaaagtcgaatcgttatgttaacataatctcaacatacatgagaggggatgcaccattatgaacgtatcatacttaagaaagcgttttgctgaagtgaaaaaatatgaaacagattgtgcagataaactgatggactttgcaaaatttctctatattcaaggccatctcaccgcaaccgaatttcgaaacagtatgaaggttctcgaagcaagtggagcagaaaacccggcgtatgaataacatacccgacccctttatataaaagaaggcagccgttttcagctgccttctttttcaatttcatcccttaatatacgaagcgtatataaaacagattcagttaaatccctgtatctttttttatgaatatgatgaacatatgattggagcatcagctccccgaaattttctgtaacggccagaatttgtgcatgatgaacgtatttcggacggttttcctgaataaacgcaagcgctgcttctgtccaaagcgcgcaaagccggtctcttttttcaacatcgggtttaatcgtctcaaaaaaatcatatgaacggcctgactcttttccatcctgataccttttttcggcttccagaaccgcctctatcatttgttctgtcagctccaataacgactgtgtctgcaaacggactcacctcagtacatatggtaccaaagtttttgcacaaaatcagcttatccggcaggctctcggcaaatcctttttacgccggtcagtcaaaaacaggtcatcaatacaaacatgaagctcccgcgcctcttcctcaagacgggaaagtttctcctgtctgatttcttcagcttccgcctgacaggatctgactgcttgggtaagcgttttttcagcagcagaaatccggatttcaatatcagaaagcagacggagaatatcagccttgctcgtgtaaacagacattcatgttcctcccttttatcacttgcgtctctttcaaatataattctcgttttcataccgctctcctctgcacatgacaaaactagaagcagttcggcaaacaaacagagattatcctaaaaggcgtgcctttcgacaaaaaagtgccgcaaactttgtatgaaccggcacgttaatgcaaacgatacagttgaggaggtgccgtatgaaaacgagaccgaaaaatgcaggtaaacagcaaaaaaccgaagcaaaaacaactgatacgcttgataaaaaattaggcggcccaaaccgcccttccacgtaacacaccagcagcccgaaaccccagcgaacggtttcgggctttttcatttcttcagccactctttaaccgcgaagagcgcatggagctcccgtcttttctggaagtaccagtccgtcagttcaagctgtttcggcattttctcctgtaagaaagccccttttcttaaccttttttgaaaccaatccgccctttcgccgtctaatgggtgggcaacaatgggataggttgtcctcagcatgggtgatgttctttttttgattccgatcattttctccatatcaaagcgtgaaccggtatgaggaacggtatcaagaaaacggtaaaaagaagcgtgaagatcagggctgaacagaaggcgggccagctgttttccgagcgtaattctctcttcggtttttgaaaaccgtttgacggaaattccgtataaatgtccgtcgtcaaatgaagggaatatcaccgtattaaagtgaaaccaatcacttaaataaaaaggaatcgtgccaaaaacattctttttaaacgaaggattttgtataataggtgcttggatagtgttttgttcatttataataagagcatacatgagccgttccgtatctccgtcacgccaaaagcggaaccattcttcctgcataaaagccgagacgcggaaatgaggaagatgacggaaaagaggttcgccgatttgttttgaccactggtagaccagaagctgaggataggcatcagaaaaaatcagccaattcgccctttcatacgaaaggaaaaaccagtttttctgactgctgtcaaggccctcctgataaaggacgcctcttaaatcagtcatcgaccagcccgcattgcgggacacaaaggatgccaaaagcggccacttgatctcaggatggcggtcataatatgctttataggcattcgtccgggaaatattatcggcattttttattttcgtctctttttcgatcaggcgaagaatggcggttacggtctgtcgtttatgcacgttcattcacttccgtcactattagtttgataaggaggatggaaaaagtgattcggtacccgaatggaaaaacttttcagccgaacaaaacggtttcatcccaaaacagccagaaacggtctcattcatacagtaatcgcggcatgaccctcgaagacgacctgaatgaaacgaataagtattatctggctaaccaaattgctgtcattcacaaaaagccgacacccgtccagattgtaaacgtccactatccgaaaagaagcgccgcagtcattaaggaagcttattttaaacagtcttcaacaactgactacaacggcatttataaaggacgctacattgatttcgaggcaaaagaaacaaaaaacaaaacggcatttcccctgcagaattttcatgatcatcagattgagcatatgaagcaggtggtcaggcaagacggcatttgttttgttattatatccgctttcggaaaggtttatttcctcgaagccgacaagctgtttgtcttttgggagagaaaggagaagaacggcagaaaatcaattcgcaaagacgaattagaagatgcttcctttccgatttcccttggatactcaccgagaattgattatattagtattattgaacagctttatttttcgcaggaacagtagactgagcgaaaggttgataaacgaaaggttgagatgttatgtcagatcaatttacgagccgtgaagaacgccgtaaggcaaggcagacgaaaagcactaagccctcttcaccgaaaaaaggcaagaaacagcgtaaaggcggtttattcaaaaagattgtgctgtccttggttattctgtttgtccttggcatagtcggcggagccgcggcatttgccgttttggtttccggcgcgccgtctttggatgaagccaagctgaaaacgccttactcttcaacgatttacgacaaaaacggaaaagaaatcgcggaagtgggcggtgaaaaacgaacctacgtcccgattaaggatatacccgatgttgtgaaagaagcatttatcgcaactgaagacgcccgtttttataagcaccacggtatagacccgattcggatcggaggcgccttggtcgccaactttacggatgggttcggttcagagggaggaagcacaatcacccagcaggttgtgaaaaactcgcttttaacccatcagaaaacgattaaacggaaagcacaggaagtgtggctttcactgcagctggagcgccattattctaaagatgaaatcttagaaatgtatttaaacagaatttatttctcaccgcgcgcctacggcgtcggtaaagcggctgaagaattcttcggcgtaaaagacttgagcaagcttacggttgaacaggcggcgacgcttgccggaatgccgcaaagcccgaccggatataacccggttaaaaacccgaaggcttccgaaaaacgccgaaacatcgttctcagcttaatggaaaaacaaggattcatttcaaatgctgaataccaaaaagcgaagaaagtgtccatgaaagatgaaggcgtcgtcagccaaaaggaatacgataaaaaggacacaaataaatacagcgcttttgtcgaagaagttatgaaagaaattgagacaaaagaaaagaaagacgtcgatatttcaactgacggactgaaaatttatacgactcttgatacgaaagcacaagattatcttgatcaattgatgaacggcgacacagccggctttaccgaaggcatgcagggcggcgtcacgctccttgatacgacaaacggagaaatccgcgccatcggagcaggacggaacagaactaccgggggattcaattatgcaacacaaggtaaaacccagcccggttcaacgataaaaccgattcttgattacggcccggtcattgaaaataaaaaatggtcgacgtatgagcagattgacgattctgcatatacgtactctgacggcacaccgatccatgattatgacaatagatacagaggccagatatcaatgcgagaggccctcgcagactcacgtaatatccctgctttaaaagcattccaagcagttggaaaggataatgccgtggactttgcaaacgacctgggattaggtttaaacaaagatcaagtatatgagccctactctatcgggggatttggtgagggtaaccgcggtgtatctactatgaccatggcaggcgcctacagcgctttcggaaataacggaacgtacaatgaaccgcatgcggtcacatcgattgaatttaatgacggcactaagcttgatttaacaccgaaaccgaaaagtgctatgagcgattacacggcattcatgattaccgatatgctcaaaacagtcgtgcagtcaggaacaggcagactggctcaagtaccgaacgtggaagtcgccggtaaaacgggtacgaccaactttactaaagaggacattcaaaaatataacattgctccaggcggagttccggactcctggtttgtcggatacacccctcaatatactgcggcggtttggactggtgtagaatctggcaacaaagcaggcaagaaatcactgtcttctgcagaccagcaagtcgcaaaacggattttccaaaagctgatctcatacgttgatgacggtaaaggaagcttcaagcagcctgacagcgtcgtaaaagaaacagttgagaaaggctcgaatcctgccgctttagccggaccgaatacgccggatgacaaaaaagtgacggagtacttcgtgaaaggaacgcagccaactgccgtttctaaaacgtacacgaaagaaaaagccgataaaccgacaggattgcaagtgaaatacgacaaagataaaaaatcattaaccttaagctggaattatgacggtgatgcaacattcaatgtcaaacaatccgttgacggcggaagctacagtgacattcaaaacagttcggcaaaagaagccgtcgtctcagatgtcacgccaggctccacatacagcttccaggtgacagcggaaaacgatgacggaaaaagcgatacggcatcagcatctttcaaagtcccgaaagatgaagaagacgatgcggataaagataaagcgactgacgatgaacagaagactgatgaagataaagataaggacaagacgcaaaccgatgattcaaacaaagatgacgatcagacagatacgtctgacggatcagatcaaacaccaactgatgacccggataaaaatcaggatcaatccgataaggatcaaacagataacaacaatcagaatcagcccggcaacgggaccgataacaacggacagcaagataacggctctgataatgattccgattccggttcagacggctcaaataaacctgacagcggtcaaacggataaaaaccaagactcatcttcaaatatcaacgggcagtccaattcgtcaaccatccagtcaaatcccgctcattagcggacgaaatccttcaccccaaacaggtgaaggatttttttcatacaaaaaaaacctccttataagaaaaggaggtttttaacatttgttcatggcttcatatttatgatattgcttcttcatctccgtcatcaattcatccagctgaataaacgagtgaaattgagtcggttttgttaaaataaacgccattcgctccgcccaattgatcggttccgcgggaaaatgctttgtttcaagcacagtccagtcgagtgatgtgacccgctcccctgccgtccaatgaaaagcggcaatcagacaggctattcccttcagcatgtcattttgatcacatctcgattttcttgtttgaaaaacggggagcagcgtttctttcgtttcattccaaatctgaaacagaaacgggacatattcgcccctttccctccatggctgcactgttggctgaccgctgaaatccatatacagcggatggcggcgcagcgccgctttgatctcgaagctttccaagtccgtaaggctgcgcaggtatgtttcatagcctgccagaatgtcaatcgccgtcaccgtttcaccagcccttttttgtcacgcttctgcccttctctgcatagcggaagcaaaggacattccgcacagcggggagattgcgctttacagtgataccggccgaaaaatattaatctgtgatgcgtaacagaccaatcctctttcggcacttttttcattaatgttttctctacttccaaaacagagtccttccagcggcagatgccgagccgtttagagacccgctccacatgagtgtctactgcgatcgcaggtacgccgaaagcaacagacacgaccacatttgccgttttccgtccgacacccggcagcttcacaagctcatcccggtctttcggcacttctccgccgtactcttcgatgatcattttgctcagcttttgaatatttttggctttattacggtacagaccgattgatttaatatcctgctggagttcttccagcgatacggcaagataatcttcgggccgtttatatttttgaaatagcgtttttgtcactctgttgacgagagcgtccgtacattgcgcggataatgcgactgccacaaccaattcgaaaggatttgaatggacaagttcacattctgcgtgcggaaacatatcgccgattttttcaagacaatattcaatctgctttaaatttaacacgtttctccccttctcatgttattgttccagccaattgtaaaaaggcacctgcctcgtatactctttttgcggatcattctgtttcgtttgaacacgccggaatttttggctgtgcgccttcgcctgctcaaccgttttgaagccgttctttttccattcaaataaaatccggtcaatatagcgaaaactgagtttccccgataaaacggcttcttttaaggcgtgtttaatcagaatcgcatcatgctgatcctgatcctgccatatggccagcgtctcgcattcaagcggcgacagcggtcttccgaactcttcttcaaagatggtatacaggcttttttgttctctttctgacgttctttcctgcgtttcattttgagaatgctgcatgtaatcatacagcttcgcccataacggctgcagagaatatttttcaaactttatgccgttatggtcttcacattcttcaataaacagaaaacctttttgaataaacattctcaggcagcttgtacattcttcagcagagatggacatgcctgattgaagttcaaacggcgtcggaaaataagagcccttttccaaatgcattttaatcttcaaaagcaggatcaattcggtttcattcagcccgagctgccggtaatgtgtcagcagcaggttgggaatgcttgaaatgccgagttcctgcatatctataaattgctgttttttcatccttacacctcttactgtaaaaggttatctccgggagctttcccctttacttagaaaaagtctcccttgcaggagacttcgtttttcataactattacggatacagacggttcagaagtctcgggaacggaatcgtttcacgcacgtgaggcgctccgctgatccaagccactgtccgctcaagtccgaggccgaagccggagtgcggaacagaaccgtattgtctgagttcagcataccatttgtaagcatctgaatccagaccgtgttcttttaatctttcttccaataaatccatatcatgaacgcgttctgaaccgccgatgatttccccgtagccttccggagcgattaagtcggcacataacacgacatcgtcacgatctttggcaggctgcatatagaacggttttaatgacgtcgggtaatgagtgataaacaccggtttgtcatagctttctgcgatcgctgtttcatgcggcgcgccgaagtcatctccccactcaatatcgtcaaagcctttttctttcaagaattcgatcgctttatcgtacgtaatgcgcgggaatggcgctttgatttgttcaagcttcgatgtgtctcttcctaatgtgttcagctcgatcttacaatgttccagcacactttgtacgatgtatgcaacataattctcctgaacttcaaggttttcttcaaattcaacaaatgccatttcaggctcaatcatccagaattcgatgagatggcgtttcgttttcgatttttccgctctgaacgtcggtccgaaagagaatacttttccgagcgccattgcagctgcttccatatacagctggccgctttgagacaagaaggcgtcttcatcaaaatatttcgtcgcgaacagctcagtcgtgccttcgggagcgcttcccgtcaaaatcggcggatcaactttcacgaagccttctttgttgaaaaattcataagtcgcacggatgatttcgttgcggattttcataattgcatgctggcgtttcgaacggagccataaatgtctgtgatccattaagaattccgtaccgtgctctttaggcgtaatcggataatcagtcgcttcgtgaatgacttcaatggatgtaacagcaagctcatagccaagcggtgaacgctcgtcctctttcacaattccttttacataaagtgacgtttcctgcgtcactgacttcgcaatttggaagatgtcttcttctacttcagctttgacgacaactccctgaatgaagccggtaccgtctctcagctgtaaaaatgcgattttaccgcttgagcgtttattagcgacccaagctccaatcgttacttcctcgcctgtgtgtttatacacttggttgattgttgttttcaaactctttccctccagaacaagaaagacattcaggaatctgcctgaatctcttttttcatcactttattatacccgttctactctaacggggtcaatgcaagtgaaaagcggctttaaaagccgctttttcagaatcagctgtgtttttccgtaaagcggcggattctcttgaccgcttcttctaaaagatcgagtgacgttgcgtaagataagcggacgttgtccggtgaaccgaaacccgagcccggcacgatggcgactttttcttcttccagaagcgccttgacgtattcatcgacatctttgaatccgcagttttctgcggccgctttggcgttagggaacaagtaaaacgctccttcaggtttgacacaggtgaatccgggaatctcactaagctgagcgtaaatggtattcagtctgtgctcaaatgcctgtctcatctcttccagcggctcagccggcccgttataggccgcaatggcgccgtattgagcgatggacgtcggatttgaggtgctgtggctcgcaaggctcgtcatcgctttaataatcgtctccgaacccgctgcatagccgatcctccagcccgtcatgctgtgagatttcgaaacaccgttaatgatgatcgtctgctctttcaattcacttgaaagctgtgcgattgagacgtgtttttttcctccgtatgtaagcttctcataaatctcgtcagaaacgatcagaatgccatgctccagacacacttttccgagttccgcaagctcttctttcgtatacataacacctgtcgggttgcttggtgaattgataatgagcgcttttgttttctcggtgatagcctgcttcagctgctccggtgaaattttaaactgattggattccagcccttctgcatagacgggacgccccctgccagtttcacctgctcaggatagctgacccagtaaggagtcggtataatcacttcatccccttcatcgagaatgacctgaaataatgtatacagagcgtgtttcgctccggtgcagacaatgatttctgacggcttatattcaatcccctgatcgtttttgaatttttttgcgatactgtctttcaaggccggcagaccgcctgaaggcgtatattttgtgtggccttcattcatggaacgcaccgcggcatctataatgtgctgaggcgtattaaaatccggttctcctgctccgaggccgatgacatcatggccttctgctttcagctctttcgcttttgcagtaattgcaagtgttgcagacggtgttaatgcggatactctttttgccaatttcaacttgaactccccctaatacgtctcacggtgtgatgtttttgagaatcttgccgcttgtaaagtccacatagctaaagctatactgcccgcttttgttgatataggtcacttcccataacggaacattgttttctctcgccgggtgaacaccattcagcttggaaacaagcccttcgtcccgaacgatcttggcagccttgccgcttgaaatgccgtcactggctttttttgagagaatttttgcttttttgtcggccggaacccatacatacatatcttttccatgtttatccgttccggtaacaacataatatttctgtttgccgacaaaggtctccactttctcagcatctgtcagattcgttttttctttagcggctgcggcagctgtttcgtggccttcttctttttgagccattgcagatttaaaaatgctggccgaaaataaaagaactgctaaaaaaataataccaaatacggctgtaaatattaatgctttttttctcatctttttcacctatgtgcgataaatggtgaagaccgcttcattttgattttcttcgtcgagcgcaaggccgaacatcaggttgtcccgtttcaaagtccggtttaatgtatcgacgattttatataaatcatctgaatgctccacattaatcgttgacagaatttcaattttgctttccatttttataccctccatcggtcgaacaaattttgttagtcataacgggatgcgcccgcggcataataaaatcacaaggcggcatgaacccgcttttactataaaaacaattcctcatcccacaccacgaaagccgcgtttatgcggcttttattccgtttggctgacataagcccccagctcggcatccgtcagctccaaaagggatgaagtcgggagcgcttcaagaaacagccgtccgtatcccgccgtctttacacgctgatctaaaagaacgatcgttcccttgtctcccgccgtacggagcaggcgcccgatcccctgtctgaacgttaacacggcctcaggcagggaaatcgtctgaaacggatttttcccctgcttcttggcaaattcgcattttgcggcgtgaagcggattatcaggtgccctgaaaggaagtcttgcgatcatgacggttgacaattcatcccccggaaaatcaacgccttcccagaaatgattcgtcccgagcaaaatcgcccggcttgccgttttaaaggttttcattaatttaccgggactcccgcctgaaataccttgggcgagaagctgaatgcctgagatctccatactgagtttcagttcctgatacacttttttcagcatatcatgagacgtaaacaggacaaggatcttcggctgttttccctttgacatgatttctgcatacttggcaatatgctcaatgacttcccgctccccgtcatatttaacggatttcatctctttcggaatgatgacgttcatctgatcatcgtaagaaaaaggagacgggatgcttttggtgcgcggataaaaatccgaaagtccgagcctttcaatcataaattgaaaagactgctccaccattaaggtcgctgatgtgagcacaacgctttttttgcgggcgaaaaactggtctgccagcatttcaccgggctccaaaggctgcgcatagatgctgacggcattttttgcgcccttcgcatcaatttcaacccaaacggcttctttctcatcattttcaaacagcagcctgctgaacgtatcgcgatattctttcagccccctgatacactttacatattcgcccgctaaaaaagccgctccgcttttcatctgatcaagcttttgatgtaacagtttctcctgtacggaaaacatgtcaagcagctgatccagcatcgcacaaagccgctccgctccgtccgttatcatgtgaaaccccttatcctggcttttatgattgagactatagacgagacggttcagatcgtctttaggttttcttcgtttgacaaaagaatgcactgaactgaaaaatgcgtcgctttccgattgaatatgcttcatccactcatcggcgtcaaaaaaactttccgccggcagttcatacgtataaaacagttttctcatccgctttaacagtccgtgttcctttaaggttccgattcggctgagctttgtgtgcagtccgatgtatgaagctctcttccccaggtgctcgctggcagcgcgttcgaaatgatgcgcttcatcaatgatgaccgttccgcttgcaggcagttttttcgtttcactgctttgatctgaaaacagcaaagcatggtttgtgataatcagatctgcggcctgcgctttttctttagcccgttcataaaaccccgcagccgagtccttcccttttttcataaaagaattctcatcgtaagccatgcgctcccacagcaatctgccgcctgatggaagattcagctcagcggcgtcgcccgtttcagtctccgtcagccagacgagaagctgcgctttcgtcaaaaccgcatcatagttgtcatcttcctcatgcagaatatgttcaaacttcggcaggcacagataatgtgatttcccttttaaaatagcggctttgaccggccaaggaaacatacgctccaaaagcggaagatctttagacatgatctgctgctgcaaaagagtagagtacgtgctgataatgacgggagtttgttccgctttggcaaataaaacagccggaacgagataaccgatcgtttttccgatgccgggcgccgcttcaatcagcgcatgctcccgattgcggaaggcgccaagcacttcatccatcatcgtaagctgtcctttccgcttttcatagcgggggatgatgccggacaagatctgttctttttcttcgttccacttttcaaggtcaatggccgcattcaccggacgggaaaccggaatttgatcgggctctttaattgaaaaagaggcgtatggaatgcagctcttttcttccgccggcctgctttcatgtataaaggaatccaaaagcagcgtcaaatcgctgataaaatgctgtgaaagccttctaagctgctttaacgtcggtaaaggcagatgtttcagtttatgtaaaatgtctaaaaagaccagtcccgtaacctccgcatcgctgtctgcgcggtgagggcggtcatgaacaatattcagctctgcgcacaactcaccgagcttatatccttcaaaccccgggaaaacaatacgcgaaagctcaaccgtatcaagcacttcacaatccggcagctcatagcccgcttcgctcagttcatgccggacaaatccgaggtcgaaatgaatattgtgggcaacaaaatacgcgccgtcaagcagatgaaaaatctcctctgcgaccgcttcaaacggcagttcattttcaaccattccggacgaaattccggtcagctgttcaataaacggcgggatggcctgattcggattgatatattttgaaaaccgctcagttatttgtccattttcaatgacaaccgctgcgatttgaatgattttatcgccctttttcggcgaatttcctgttgtttcgacatctatgacaacgaaccgttgtttgttcattaaaatggacacctcaattcttgcttacgagaaaagtgtaacacgttttgttgagaaatggagcggaaaaacagcttttgcccctaaatcttaaaagaaaacccccatgaagggggctcttttacaaaatcgtgtgtgccggttcctggcccagcatctgctcgattttattctgatcatccagaacggccaccttcggctgatggctttttgcttcctgatcagacatcatttgataagaaataataatgactttatctccttcttggacgagacgggcggcagctccgtttaaacagatgacgccgctcccccgcttaccgggaataatatacgtttcaagtctcgctccgttgttattattcacaatctgaactttttcattagcgagcattccgacggcatctaaaagatcttcatcaatcgttatgctgccgacatagtttaaattggcttccgtcacggtagcgcggtgcagttttccggccatcatagtgcggtacatattatgatctctcccattcatcaatatcaataatgatattatcaatcagtctggctttagaaaattggacggcgcaggccagaatgaccttgccgtttaatgttttaagcggagtcagctccggataagcgtacagttcggcataatcaatgacgccgcttgtgttttcgatgataccggtgacggtttttataacggtttccggatttctttcaccgtctctgatcagttcggcaccttgctgcaatgctttatagatcatcggcgcttctttgcgttcctgctcagtcagatagacgttgcgagagcttttggcaagtccgtcttcttctctgaccgtgtccactgcaaccaattcgatatccataaagaaatcctcaatcaatccgtccacaaccgctgcctgctgggcatctttcaggccgaagtaggcgcgggtcggtttaacgagattgaaaaacttcgtcagcacagtggccactccgtcaaaatggccgacgcgggaggcgccgcacaacacgtcagttctccttttcacttgcacggcaacattttgctcgcctttatacatgtcacttggagacggcgtaaacaaaacatctgctcccgcctgttctgcaagccgggcatcgcgctttaaatctcgcggatatgcttcgtaatcctcgcccggtccgaattgagtcggattgacaaagatgctcatcacgacaatatcgttttctttgtttgctttttcaaccagcgtcaggtgtccttcatgaagaaaacccattgtcgggacgaatccgatcgtccggccttctgagcggtattgtgcaattaattctttcagctgttgagtttctgtcagttgtttcatcgcttactttcctccgtataagccttgcagcacagtttggtttatctgaaaggaatgcttttcttccgggaaaacccgttctttcacatcacggacataatcactgagggccgactcaatcgtgccgtcgattttggcgtattgcttcacgaacttcggtgttctgtccacgccgtggccgacgacgtcatgatagacaaggacttggccgtccgcttttgaaccggctccgataccgatgacgggaatggatacttcttctattattttagcagtcagttcagcaggcacacattcaagcacgagcatcatcgctcccgcctgctcgcatttgatgctgtcttcaatgagctttttcgcgctttgctcatcttttccctgcactttatatccgcctaatacgccgacagactgcggtgtgaggcctaaatggctgacgacgggaattccgccgagagtcagcgcgcggatggattcgaaaacgccgtctccgccttccagctttaacgcgtccgcgccgctgtcctgaataatggccgcggcgtttttcaatgtatcctcttttgaaaggtggtaagacataaacggcatgtcagttacgataaacgtatttttcgcaccgcgttttaccgcttttgtatggtgaatcatgtccctgaccgttacgccgacggttgaatcgagtccgagcacgaccattccgagcgaatccccgactaaaatcatgtcgactcccgcctgttccgcaagctttgcctgcggataatcgtaagcggtcagcatcacgatcggctctccgttttccttcattttcatgaaatccagttttgttttcattctgtttctcctcctctaaacggtgaggagatgagccgccaattcttcgcaagcaaaaaagccttctgtaaaataagaaggattcccacttgtttaacgttcggcgaatgtcatccctctgtcccagtccttttttggatcaaggcagacttttcgtaatctctgttctgctgatcaggtgcagttcattatgatactgcccataggaagtataccaaattcacgaggcttgtaccaactaagattaattgagctcaatatcggcagaatagatcttctttataccgtctctcgtttccaaaagaagaactccctcatcatcaatgccgagcgatttcccgtaaaacgttccttgcagcgttctcgctctgagctcgttccccagtccgaccgcatagctttcccatagcagcttgatcggtgtaaagccgtggttcaagtaatcctgatagcgtttttcaaaagtcagcagaatctcttgtatcagacccgctctgtcaattttttcgccggcttccatgctcaggctcgtcgcaatgtcctgaagctcgccgggaaaatcggtttcctgctggttcacgttgatgccgatcccgagaataaccgaacggacacggtcctcttccgcctgcagctcagttaaaatcccgacggcttttttgccgtgaatcattaaatcattcggccatttaatggcggcctgtacgcctgtaaaagcctcgatggcctgtacgaccgcaacggcggataacagggtgagctgcggcgttttttgcaaaggaacgtcgggtctcagaatgaggctcatccaaatcccgtttccctcctgtgaatgccatactctggccattcttcctctgcctgccgtttgtttatcggcgactacgagggtcccttccggcgcgccgtcattggcaagttcatgagcggttttttgggtggacggcaggacgtcccggtaatgaagctgtttgcccaaaacttctgttttcagtccgaaacggatttcggattcactgagtttccccggttttttaatgagcctgtacccttttcgtctgaccgcctcaacctcatacccctctttgcggagctcctctatatgtttccaaacggcggttctcgagcagccgagcgcgtcacttattttctgcccggagataaagccgtcacccgcctcagaaaataaatcaattaatcgggttcttaatgttgatcccatgatgcgagccactcctttatgtcatgttttcggttagggagcttccctgccaataccgcttcttcaatccggcgaagttcttcggccacccatttacccgcgcggcggtttctgagctccatcagatcagcgcctgaaatgtcgaggtctcgaaggcttttgatcggcagctgctcatacaggctctgaacttctttcagcttttgttcatcaatcgtcctatgctgtttcagcatctcgattttaacggctgaaaacagcgcctctcccgcccggtacatcgcttctgcttccagctgcgccggataaacgcttatgatctgcaccgctttttttatgacttttcccggcagtttccattgttttaaaaacgcctcggcgcttttcggacaaagaccaagaaacaataacagcgctgcccagcgttcttcgcgtgcatctaaagaagaaaacggaaagccgcttgcttcaagcatttgctgctcataaccggaaaggacgggcagctcttgtatcagacctgtctgcaccatcgtttgaatcgcttcttgtgagaaagcgccctgcatcagcttttcaaactcgacggtctttcgttctactgatacatgtgccataagctccctgtcttttatgacggcctctcttgtatctttttctaacagaaagccgagctgactcataaagcggacggctctcatcatccgcagagcgtcttcccgaaaacggtcttcagggttacccaccgtacggatcagcttttgtccgatatcatgtgcgcctccgaaataatcaagcagctctccttcggcagacatcgccatcgcattaatcgttaagtctctccgctttaagtcttctgataaagaagtaatgaaccgcacagcttcagggcgccggtagtccttatattctgattcggcacgaaaagtggtgacttcataggtttcatcttcccacaggacgatgacggtgccgtgctcttttcctacatcgacagtccgcttaaagagacgctccacctcattcggcaaagcgctggttgcgatgtccacatcacctatttttcgtttcatatagctgtctctgacggctcccccgacaaagtacgcctgatggcccgccttcatcagatgatgaaggatggggagggctttgacaaattcctgttccataagatcactccggtcctgccaattcgtcataaatccgttcatactgactgacgattctttgcgaagaaaaggcggtctccaccattttgagcgcatgatcagtcaatcgtttgctgagctgtttatcttctaaaacagcaagcgctttttcagatgctccctgaatatcgccgacttccaccagaaaaccgcttacttgatctttaatcacttcggggatgccgccgatatttgttccgatacacggcacgccgcaggccatcgcctcaaggaggacgagtccgaaactttctttttcagacagaagaagcttaagatcgctgatggaatacagctcttccaccctgtcctgatttccgaggagcagcacttgatcctgcagtccgtatttttcgacaagctgccaagcgacgcacttttccggcccgtcaccgacaagcaggagcttcgcctttgtgttggctgcgatattacggaaaacgcggatgacatctttaacacgttttacttttctgaagttcgaaacatggatgacgaccttttcatccggcaaaataccatgtttctcttttatactctctgtatttttcttaagataaacacgttcatcaataaagttgtagatggtctcaatttttttatccggcttgattaagtcatacgtttctccggcaagcgcggttgataccgccgtcactctgtcggacgcttcgatggcaaaacggattaaatcttttaatgacggatcatatcctaaaacggtgatgtccgtaccgtgaagcgtcgtcacgatgccgatgtcacgcttgagcatctgcttggcgagataagcgcataccgcatgcggcagcgcataatgcgcgtgaatgatatcaagattttccctcgcggccacctcggcgattttgctcgccagcgtaaggtcataaggcggatatttaaataccgcgtattggttgacttccacctcatgaaaatgaatattcggatgatatgtatttaatctgaacgggatgcttgatgtgatgaaatgaacctggtgccctttttccgcaagcagcttgccgagttccgtcgcaataatacccgagcctccgacactcgggtagcatgtaatccctatttttaatggtctcattgtccgcccccaaaaacatcatcattcaaaacgggaagctgttttgaaaagaagccttcagcataccccgtcccggcttctttgccatacagtctttcccgcgcttccaccatttcgatataaccgttggtcagcggtgtgttcactgactgcgccgtaggaataaactggctttgataggcgtgcaggctttcttttttcagatcgatggtttccgttatgtcgattacaaagtccggacggtgaaacccgttgatcatataatagtatacgcgctgagccttatgagccggcagttcctgatgatctctgtatttatgaattcccgccgagaacaccgcctcttcgaccaaagccgccgcattgccgtggtcaggatggcggtctttcggataaggcatgaaaacggttttcggccggcaggctctgatgacactgacaatccggcggatgccgtcctcacttttcaaaagcccgcggtcgggaagcgtaagctggattctctcttttacgccgagaattcgtgccgcctctgccgcttcttcttttcttatccctaccgttccgttagatgatagttcggcctcggtcaaatcgcatatcaccgcggtttttccttgagccgtaaattttgcgatcgtgccgcccataccgatctcgacatcatcactatgagcgccgaacgccagaatatcaacgtgttcagacattcggctctcctccgcgcacaagattgcggaaatcaaatgccccgccgtccagcgtccggacgaggatttccgctgttcccatatttgtggcgagcgggatcgcgtatacgtcacacagccggatcagcgccgagacatccggttcgtgaggctgcgcagttaacggatcgcgcagaaaaatgacgagatccagggcgtttgccgcaatcaatgcgccgatttgctgatctccgccgagcgggccggattgaaaacgttcaacggacaatccggtcgcttcctggatttttaagcctgtcgtacccgtcgcgtataactcatgatggctcaatatatctttatatgcggtcgtaaactgaaccatatcctgcttttttttatcgtgagcaatcaaagcaattttcattgatgttctcccccttgccgattcagtcgataatattttcgagtccgtatacaagctggtcgattttcatcacttgctccactgacagcttcactcctgacataaaggaagcccggttataggagtcatggcgcagtttcagcgtttggccgtccatgccgaacatgacttcctggtgggcgataaggcccggcagacgcacgctgtgaaggcggatgccgtttaattcagcaccgcgggcgcccggcagaatttctttttcatcaggatggccctgctgcttttctgtacggacgcttgaaatcatttccgctgttttcagcgccgttccgctcggggcatccagcttttgatcatgatgaagctcaatgatttctacatcttcaaaatagttggcggccatttgtgagaacttcatcatcagcaccgcgcccaatgcaaaattcggagcgatgatggcgccgattcctttttcttcagtcaaagcttgaagctcctctaaatccgcttcagaaaatccggtcgttcccacaacggggcggacgccgtgttcaagagcggctttcgtatgttttttgccgatttcaggcgttgtcaaatcgatcagcacatccggttttgtttcttggaaacatgcgcggatatccgtataaataagagcgtctgaatcagctgacatcacttcccgcaatgtttgctgatcgtatgtatggtcaatagcgccgacaagctcaaaatgaggcgtgcggacggcaagttttacggcctcctggcccattctgcctctcggtccggcaatgacgactttaatggtttcatttgacatggtttctcctactttccttcttcttttctagtccagcggtctttatcacgtgtattaaatttatgcatgacgcggttatgagcttcctccaatgaaatatcaagggagttggcgaggcagatcaggacgaacagcacatcgcccatttcctcttccatgcttttctcattttccgtcgttttcttcggcttttccccataataatggttgacttctcttgcaagttcgcccagttcttccgtgagacgggccatcatggcaagcgggctgaaatagccttctttgaattggccgatatattcatcgacctcagcttgtaagtctttcatcgttttgtcactcactgtgcgaatacctcctgtcatctcttccatgttagctaattcaagtacatttgacaaatgttaaaaacggcagtttgctgttttcttttgtatccactataatatttacgcaatcttatggaaggaaaaggggtttgatgcaatgcttggagaaatcagaatcaaaaacatttgctttattttaatcggcgccgctgttttttcattcggactggttcactttaatatgcagaacaatttggcggaaggcggatttaccggcattacgctgcttttatatgcgttattccacatcagcccttctatttccaacctggtattaaacattcctatctttttcatcggctggcgtatgctcggccggacgatgtttgtctataccctgatcggcaccgtctctctttccgtttttctgagtgtttttcagcgctacgaaattcatatgccgctgtcgcatgatttagcgctggccgccttgttcgccggtgtttttatcggcgcgggtctcggcattatttttaaatacggcggcacgacgggcggggtcgatatcatcgccaggctgatcaacaaatttttcggaatcccgatgggccggacgatgtttgcctttgacgcctgtgtcattctgctttctttgtttacgtatctttcttacaaggaagcgatgtacacgcttgtagccgtttttgtcgctgcgagattgattgattttatacaggaaggcggctatgccgcaaaaggggcaacgattatttcttcgaaaaacgatttgatccagcaaaaaatcattgaagagatggagcgcggcgtcaccgttttaaaaggacagggatcatatacaaaagaagacagggacgttctttactgcgtcgttccgaaaaacgaaattgtgcttttgaaaagcgtcatcacttccgttgacccgcacgcctttgttgcagtaagcgacgtccatgatgtgctcggcgaaggatttacgcttgatgaaaataaaaatccgatcagacgataataaaaaggcggcttttgccgcctttactgttcgtgtttccatttgacaaccggtgattttttctttttcaatcggcgggcgaatgccggactgacattgagcgtctgctcgacaaagcgctgcggcgtcagtgccagccattggtttaaggagacatcttcgaaacggtcgcttttgaagatttccagaaagcgaagcacggtgtcaccggtattctgaacataatgtcccattgcaaaaggaacatatcctacgtcacccgcttgatagttaaatgtccgcgctcttccctccgccgcaaacaccgtcattttcgcttctcctgaaagataatactgccactcgtccgtattgggatgccaatgcaattctctcatgcctccgggttcgacctccacaagagctgcggcaatcgtttttgacaccttaaacgtttttgaatcgacaatctttactcttcccccgccggtaacaagaggctcctgccgggaaagcttgtagctgaatggctccaaaacggggccttccggggaagaaactgctgcccgctcaatagggggaggcggttccagctggaacatgtaacgctctttcttgtgaatgtaagccagctcataacccggaacaccgaagttcgcctccagcacgctgcgcggggtatgggcaaaccagtccgttactgaaaaggtgctgttttctgaaaaagagccgtcatcaaagacgagcaaaaactcacttccctgctctaatccttgaatggaatgaggaatgccggaaggaaaataccacaggttcccttcacttacgttatcaataaaattccgcccattttgatcgaccgcagttaaacgtactcctccgttaatcacatatccccattcggcttctttatgccaatgaagctcccgcacagctcccggtttcagtctcatgttcaccgccgcgatgtttttggataccggcagttccctgaccgtcacctctctggaccatccgccgtcttcaagcctcatatgcgtatcagaaaatgagaatttcaagttttgaaccgttcctgcatccgttgaaggcggaacgagcatgtcaggattctggaagtcacgcgcgaggtttcgcggtccttcgtcagtcgccccttttctgcctctgatcggctgcgggaggtgttttgaagccaattgctggatgagttttttcactggcttagctcctttacagcaatttgtgtttatttagacttaggatactcacgctttttctctttctttttttccgctctgtattttcggtagccgacatatgtcagcgcagtaataatgataccgcctgttgtcagaatgacccagagcagcgaagggtcagcgtcatcccgctccaccttgtcaaaaacccgctttaaatcctgctgcaggagcgtcagacgctcaagctttgttccttttgtcatctgctgaaacccttcctgctcaatcacctcgatatgtttcgccaccgtatcaagctggccggccgacacatccattgtcaggctgggataaattaaatcatataatgatataaattcattccacttttcattgaaattttcacttccgtttccgctgacatcttcttttaaggcgctgaatgtcgccataatcggtctttcaagcgaaccccacagcggatcggagtggtcttccatcgcatccattaccaacctgaactgggcggctgcccggattttttcggtatctgaggcgtctgcctgtttcaggacgcgcactaaatcattaaagcccagagtcacctgcctgacttcggcgccgctcagtgagtttacgtgtgtcatttttttcttaaagtagccaagcacttgcagagcctcatcatactgcgaatgccgcgtcatttggaaaacggtatccgaaaggtcgttcagttccttgagaccgccctcatcttcagctttggcagttgtgatgaaacacataagagcaagtaaaagacagatcgtcagctttcgtttcatagaggtccctcccactccttctctttacagaatatgaggagcgggacaaggttagaccaagattctatcagtgtaagtcaagctttatccgtcttttggaaatcaccaaatagtatgcaaggccgagtgaaaatatgctcagccagaatgtagcatagccgatctcttgcatatagtcattgagcattgagtagcggggcatcatgccgaaaagataatcaatgacatcattatgaagcgtccaaacagcggcaacggcaagatgccataaccggaaccgaaaatacgggctgtataaaacgccttgaacggccatggcaaaatgtgaagcaatcagcatgtacccttcccaaggcatctgccccattttgaccagcacaaagacattcattccgaccgcccacagcccgtattttacaagggttacaagagccagcgcttcaaacagcggcgcgtttcttcccatgagaaatgccagaagcacaaacaggaagaaaaacgtcgccgtcgggctgtcaggcacaaatatcagaaatcggaacggcgtgtccaaaagctgcggcacataccaataatagccgtacaccgtaccgataaaattaacggcaagaacaagcagaagcatgccgcgcaaccctaaaagataagaaatccacctcataccatcaactctcagtccgtaaaaagtatgtatcatgcaaaaaaagctgacatccggtcagctcttttcataaaagtatatcctgctgttgtcttcttcacaatacgttatttcgctgtcgtttcagaaatgaacttcgccagctgatcaagctgtttgtcattccctttaaaaataccggctggcatctgccctttccctttgacggcgatttttttaatttcttccgggctcagcccgttatcgaccagggacggaccggcgcctcccccttgaagattatccccgtgacaggaaatacagccttgttctttaaataccttataaccgtctgattcagtatcaatggcggcttcttttttaattttcccttgctcctccgccttcgcccagtcatgtgtcgcgactgactgccacgttaaaaagaccgtagcgcaaagcgccaaaagcatcatcccgacggcaaccggacgcttccacggccttctttcagaccccctgtcgagaaacggagccaaaagcagcgacccgaaggcaagccccggtataatcatcgctccgataacggtgtagctccctgcggcatattcatattttaaaagctggtataaaaatagaaaataccaatccggcagcggaatataccctgtatccgtcgggtccgccacccgttctaaaggcggctcgtgcacaatcgttaaaacgagaaatccgacgaggaaaacggctccgaccatccattctttcagcaggaagttcggccaaaacgcctctgtctttccaggatactctgaatagtctttcggtatattcggttttttttcagccggtatccttgaatctcctacaaacttcattcctttcccccggtgcatgtcatcccctcccttttatatcagatttgtattaaagcggtcctgaaattccctgcttgcggatcatgacaaagtgggcgcccatgagcgcaaacaaagcggcagggagaaaaaatacgtgaatcgcaaaaaatctcgtcagcgtttgagcgccgacaatatcgtggtggccggcaagaagagttttcacctgcgctccgatcaagggcgtcgcctccgcaatctgaagacctacctttgtcgcaaacagcgccttcatatcccacggaagcagataccctgtaaaaccgagaccgagcatcacaaaaaagatcagaacaccgacgatccagttcaattcccgaggctttttataagctccctgaaagaaaacccgcagcgtatgtaaaaacatcatcacgatgactaaacttgcgccccaatggtgcataccccttacaatctgcccgaaagcgacttcattctgcaaataatacacagattcccacgcgtttttaatatccggcacataatacatcgttaaaaacatcccggacagcacttggataacggttacaaaaaacgtcaaaccgccgaaacaatagacaaaagccgagaaatggtgagcgggatttacatgttccggcacttcatggtcggcgatatcccgccacatcggcgtaatatcgagacgttcatccacccagtcataaattttattcagcatgtcacccttcccccctaggctttgcttttccaagatacaaaaagccgtcctttactttttgctcataacggtcaagaggcgcgagcggcggcgtgcccggaacgttcgtgccgtctttttcatacagaccgtaatggcagggacaaaagaatttgttcggatttttaggatcattgttccagtttacggtgcagcctaaatgcttgcagatcggagaaagcgctataatttcatccccatgcttgtaaacccaggctgatctggattcttccgattcgtaccaggcgtcgacttgatgaattttaaagtcaaaccgcttcggctccttcgtcagctcatccacactgacaacctgcaccattttttgatctcccgtcggttttaataccggatccagcgcaaaacggaccataggcataagcgcactggcggccataaatcccccacgccggtgagcgcatagtttaaaaattgtcttcttgatatatcttgttttccgcccatctcttccccccctaaagattgaccaaaaattaactaaaatagaaaataattctgagatttgacaccctcataatatatgaatctttcagcaaggtcaacagaggcaaaacgggtgttttgcaggatgcctggagtttttaagaattgttccacttctgtaacaaaacgttcaaaatttctccgcacttgtcatccgcaatttttctctttaaagagtctttcatatgttcaaacgggacggcaggtatgtatatgacatcagaccctatttcagaatccttccatttttcgtctgccgtcaggaacaaggcgtgccggaagttggtcatcacctcttctttgagtttttgaagcagggcgatttgtgattggtctatatcaacatatgtataagaggggaataaatatacccgtcccttcaattggcgctcaagctcttcagaaagcaattgggtgctttccccctgttcaacggcctcttttaagcctcctgaagacgttatggaaattaacggaatgacagcggtatcaatgtaatccgcagattgtaaataggcatcggcatcagcggctctccatctcatgtctcgttcctcctctttacgcaacaagccttgcatattctgcaaggctgtcatttatgtgagctgattcaattggcgggaaagcttttcaaatgtttctttgtcgtggcggtccagcgcctcgtcgatatctttaagcagcttttcccgctggaaagtggaaatggcatgttctaatattttttcagccatcccctgatcctgtttattttcaaacaggtctttcggcagatgcggatttgattcaagaacagcggcatattccggtgagctgtaggccgaacggaaattcagctggataaataaatcctgctgtttatttaaccggatgtcgtgaaaagatttttccgcgtccgtagtcatgacattttctttgtaaaacctaaacggcacctcatcaacgcaatgagtagacatgataatgcctctcgggcaaaattcggcttgttctacaaaatggactttttccattaatgaatcatgactcattaaataatttaaaatccagacgcactcccggcgtttaagctgataatgatttaaaaaccaacggataaaatcctttttttcattgacagaaacaggggtctgcatgtaattccctcctctatcgatcgtataatctgacatcacttatacattcagcaagcatggtccaaaatcctgcttatcttaaaaattcatcctctatccgtaagattgtttcttcaagctcttcgtttattccatccattgaaagcacttgttttaaaagcggcagcgcttctttctggagaccctcttccaataagaagtgagcgtattcatataagaaatcccgatcatcctgataatggagatacgcagcttcgaagctttttttcgcttcagcgtattgctcaaggcctgtataggcccccgccaaataccaattgtatttcggatcttcttccccgtagccgcggacttcctgaatcagatcaataatctcttcaaagctttcttctttatgatagacggctaaaagcgtatggagcgcttccacgtaacccggatcgagcgccagcgcttcctgaagaagctttttgccttcctcttcgctgccgagctttaacgccattttcgccgcatagagaaaaagctctttattgtattcatcgtaagtaataccttctttagcggtttttaatgcatcttcatacatgccttctgcctcgtagctttttgcaagcggcatataaagcgatgaataggaaggatcaagcccttttaaatcagacagctgcttgatggctgttttgaccattcccgcctgataggctgtgaacccgtacccgaaaatcgtattcggttctgtatgttctgccgccgctttttcataccatgaaatcgcttcctcaaattcacccgccgcgctcaatgactcagccagcctctgatgaacatttacgccgccgatttcgtgccgttcttttgccgtctcttcatagtaaggaacggcttttgcgtatgatccctgagtgaagtataattcccccagagcgaaatcaataactggttcatcttgtaacattgctttcgcctgtaacagcttttgctcacttacttcaaataagccctgcatctgatacagatcagccattaaaagaaggctttccgcgtaagacggatcttccggagaaatcgtctccagcacctcaagagctttttcttcttcatcaatatctattaacaattcggcgtaaaaattcgtcagctcagactcatccggataaaggtcatgcagatcactgatcagcgctaacgctttttcggcgtttccccattcatagtagagctgggctgcaatggctttgtcttcgtcatgaagctctgtttcagcttttgaaagcgctttgagtcccttttcggtttcacctgcttcaactaattttatggcttcttgaatcaatgtattcaaatcagaccggtcctttcttttcctatacctcatcaaccaaatgaaaagggtttttattcgggttattcttatcataattcagacagggcctgcccgcaaataagatgcttcacccggcattatagtttatcagaaaatggttaagaggaaaacggcaaaaaagggggcggcatctttatacgcaaacagcgcaatttgttccggctgtttctgtaacgaaaacgcattccccctttctgttatttttctgtttaagacaagctatgtcaaagcccaagattttatgacacatgaagaaaaaagcccgaagaacagtcttcaggcttttttggctaattgatctaaatgctcaaaaaatgtcggatatgagacatggatcgcctctgtatcacggatgtcaatcggctcttctgtcaggcatgaagcgataccgagcatcatgccgatgcggtggtcgccgtggcttgacacttcggctccgcccgcaagcgtttttttgccgtgtattttcatgccgtcttcagtcggttcaatgtctgcgccgattttccggagctctgatacgacggtgtcgatccggttcgtttccttcaccttcagctccgcagcgtctttaatgacagttgtgccttcagcctgcgttgccaaaagggcgataatcgggatctcgtcaattaaacggggaatgatttctccgccgatttctgccgctttcagagctgaggtttcaataaccaggtctccgtaaggctctgcgctgtccgcttctgaaggaatcacttcaagtgaagcccccatttgctttaagacatcaatcatccccgtgcgtgtcgggttcaggccgacgtttttcagcacaatccggcttccgggaacgacagcgcctgccgcgaggaaaaaggccgctgaagaaatatcgccgggcacgaaaatatcggctccccgaagcttctgaccgcccgttacggaagcgctcgtctccgtttccgcaagctcgacgccaaaagcgttcagcatccgttccgtatggtctcttgatttatggggctcagtgacggtcgtcttcccttcagcctgcaatccggcaagcagcacggcagatttgatctgcgcgcttgcaacaggggagacgtaatcaatgcctttcaattgtccgcctcttacggataaaggtgtaaaccctccgtccgctcttccgtcaatcgcggctcccatctgttttaaaggctccgtcaccctcttcatcgggcgctttgcaatactttcgtcgcccgctaccgtactgtgaaatgggcgtccggctaaaatgccgagcatcaggcggatggtcgtgccggaattcccgacatcaagaaggctgtcaggctcacaaagtgcgtcaatgccctttccgtatatcgttacatcacttccgttttgttcaatggagacacccatttttctgaagcaggcaatggtgctcagacaatcggctccgggcaaaaagttttttaccgttgtcgttccttccgcaagcgctccgaacataacagaacggtgggagatggatttatcccccggaatatgaatttcaccgtttaaagacgtcactttttctcttttcaatgttttccacctcagtcagcgtaaaatgtgtcatatttggcgcgggattgaatgcaggtttccgcgcgcttccggtcatcatcagtctggaaactgattctgagaattccgttaatatcttctcttgtttcgataatgcggatgttggtgatactgattttttcttctgccagtatcgccgtaatttccgaaatgacccccggatgatcaggaacatcgacataaaggtcataaaaggacgggatcgctcctttttgacggagcggcagaccgtcgcgataatctttcgcttttttaaaatatccgaacaggctgtccgcatcttcattttctacataagattcgatcgtgtcaatctcccgtttccattctttgaagcggtcaagcagtttatctttgttatgaagaagtatgtctctccacatcgccggactgcttgaggcgattctggtgatgtcccgaaaaccgccggctgcgaaacgcttcaaaaacggataatcttcttcagaatgatgagcctgatggacgaggcttgcagcaacgatatgagggaaatggctgataacgctcgttacgccgtcatgctcctcgggagtcatctccacaaagtgggcgtttgccgctttcaagagttccttcagatgcgttactgactctttagaagttgattttccgggtgttaaaatgtaaaacgcattttcgaataaaaattctttcgccgcagcggccccggatttatgagatcccgccatcggatggccgccgacaaattgatagtgagccggaagcactttgtcggcgtagctgacgactttctgtttcgtgctgcccacatccgtaatcaggagttcatgggtgatgtctgatgcggccagcatatcgagcattttcagcgtttgggcgacaggcgtggcgataatgacaacagacgcttgctgcgccccttccgtcaatgagccggcccgctcgtcaataattccgagcttcagcgcggcagtgagctgttcttccgaaatatccacaccgataatccgtttatgcggatgctcctttttgatggccagtgcgatcgatccgccgatcagtccgatccccgcaagcaatatggtatccttcatttcactcatttcctttttcatctattttaatagagcaaagaggtgatgcttgatcacctcttataatatttcagctaaaattgtgagaatttcctcattctgctctttcgtaccgaccgtaatccttaacgctgtcggaaatccgagcgcctgtcctgagcggacgatatatcctttttccaacagggcttggaacagttcatccgccggacggttaaaatcaatgagcacaaagttggtttgtgaaggataacaagttaatccgtgagtttccgcaaaatcataatactgcttaaggccggctttatttttctcgacgcattcctggataaatgtctggtcgtcaagcgctgccagtgccgaagcctgaccgattctgctcgtattgaacggctctctcgccggttcaatctggcggatcagcgcttcgtccgcaatgccgtatccgacgcgcagcgcggcaagtccgtacgctttagagaaggtgcggaggatcatgacattcggatattgctttaaaagcggaatgctttctgggtaatcttccgccgtaacatactcgtagtacgcttcatcaaggacaacgagtatatgctcgggaactctgtttaaaaaggcaattagctcttgctcagaagtatatgtccccgtcggattattggggctgcatacccatatgactttcgtctcgccgtcaattgcttccagcatccggtccaaatcatgagcgccgtcactgcggagcggcacctcgcgcacctcagcgccttcaatcaccgcattgtgtctgtattgcgggaaagtcggggcggcggtaatcgtgtttgcctgatcatttaataaagaacggcagataatctgcactagctcatcagagccgttgccgaaaatgatcgaagattcactgacctgcagatgctcactgagccgcgttctcaaagcggcactgtaaccgtcgggatacagcgcaagctgctcaatctcccgatgcagcgcatcttttgcggcctgtgaacagccgaacggattttcgttagaagcgagttttactactttttcaagcccgtattccattttcacttcttctattggtttgcccggctgatacggtttcagctgccgcagctgttctttaatctgcaaatccagtcacctcattttacactgtacagtcgtccgaacgtctttgcgtattcttcaaattcaagaagcgcatcagctcttgtgccgggattcacaagctttgttttaagctcttcaacttttttgacaagcgcgctgccgacaacgacaccgtcagatatttcattcatcccgtcaacctgtttgcggtttgaaatgccaaaaccgaccgccaccggaacagagctgaattctttcaccttacggatgaaagagtatacagaaggatcgaattcgctgcgtacgcccgtcactcctaaagaggatacacaatacacaaagccgcaggcctgttcagtaattattttcaaacggtcttcacttgtcggcgcaaccagtgagatataagcgatgttctcctttttgcatgtcatttgcaaaagggcgctttcctctaacggaagatccggaacaagcagaccgtctatgtcgttttcccgcagtaaagcgaaaaagtattctttttctaattgtaacacaggattataatacgtaaagaggataattggaatatgaacgccgttttttttcattttgccgccaagttcaatggcttttacgatattcattccgttttccagagcccgttttgaagcccgttgtatgacgggtccgtccgcaagcggatctgtgtaaggaacgccgatttcaagggcagaagcgcctgcattctgcaatgaaattgccagttcaacagaaatgtcaggaagcggatcgcccgctgtgataaaagggataaacaatttttcagaacctcgcagattaaacatgtgtctccaccccgttttccaaaacattcatcagcgtatgaacgtctttatctcctcttcccgacaaactgacgagaatgattttgtctttatccatgtcctttgccatttcaaacgcttttgccagggcgtgggcagattcaatagccggaagaataccttctgtttcagaaagcaggcgtaacgcggcaatcgcttcatcgtctgtcacgctttcgtacgttacacggccacttttgtgcagataggcgtgctcagggccgatccccgggtaatcaaggccggctgaaatggaatacggttcgataatctgcccgtatttatcttgtattaaataggtcattgatccgtgaatcaccccgagcgtcccttttgcgatcgttgccgcatgcagcggcgtatcaatcccttttccggccgcctcggcgccgatcagctcaatatcttcgtctaaaaaggcctgaaatatgcccatcgcattgcttccgccgccgacacatgcaacaaccttatccgggagcgttccttcaacccggcggagctgttctttcgcttcctcgccgatgattttctgaaattcgcgaacgatatacggatacgggtgcggacccactacagaaccgataagatagaaatgatcttcacaatgctggacccaatacctgattgcctcattcgtcgcatctttcagcgtgccgttgccgcttgtgaccggcaccacttccgcgccgagcagtttcatccggaatacgttcagcgactggcgcgcaacgtcttcttcacccataaaaaccgtacatttaaaaccgaattttgcggcggctgtcgccgcagccacaccgtgctgtcccgcgccggtttcggcgatgattttcgttttgcccatctttttagcaagcagaatctggcctaacgcgttgttaattttatgagagccggtatggtttaaatcttctcttttcagatagattttcgcccctcccaaatactctgacaccctgtctgcgaacgttaatgcagtcggtcttccggagtaatcaaacaatagtttttgatattcggcatgaaaaacgggatcattctttaattctgtgaaagccgtttcgatttcctcaaggggccgcatcaatgtttcagggacaaatttgccgccgaattcgccgtatcttccgatttcatttggatatggatacatagtggttcatcctttcttctaaaagccggatcagtgtttgatccttgtgtccgtttttttcaattccgctggcaagatctataccgcacggacgcgatctcagtaagccggtaatcgtctcaggattaacaccgcccgcaataaaacagcgcttgcttgcattttgagcctgctttcggtacaaggggacacgggcccatgaaaacgcgattcccgtcccgcctctcattcctgtcactgaagaatcaatgacatagccgtcgacagcaggtgcaaattgagccatctgacggagcgtcccttccccgtgatggagcgctttccatatttccgagctcacaagcggacggagacggagggcatcctcaggcgattcatcaccgtgaagctggatgacgtcaagtgccagatcagaggcaatttgcccgatgttttctatcgtttcatttacaaatactccgacatgtttcttttctgtccagacctgctctttccatttccggacctcatccggcgttactctccgtttgcttggggcaaaaataaatcccagataatccgcttctgaagctgccgcaagttcataatcacgcttcgatcgtattccgcagtactttaactcaggctttttcatatcgtcactccccgaacagtccgcggatcgccttttgctgtgaatcctctctcattaaggattctccgaccaatacagcctgcgccccgtgcttgttgacgaattgcaggtcagccaaagaaccgatgccgctttcactgaccagcaggcagccgtccggtacaagctgcgctattttttccgtttgcgtaacagaagtacggaacgtttttaagtcccggttgtttatgccgagaatgtccggctgaaacacttgtaaaatccgttcaagcacagtttcaccatggacttcaacgagaacgtccatgcccttctcgcgggcttccagataaagctcataaagctctgaaggttccagcgcttccccgatcagcaaaatggcatcggcgccgatcctgaacgattcctccacctgaagggaatcaataataaaatcttttctcagcacgggaagagacacggtttgtttcacatctgtcagaaattgatttctcccctgaaaaaaacgggtatccgtgagaaccgaaagggcgtcggctttagccgcttcataatctgccgcaatcgtttccggaacaaaatgctctttaatcaatcctttagacggcgaagcttttttcacttcggcaatcagcccgataaaacggttcgggttcaggagtgcttctttaaaggatctccgtttaatttgacaggtttccggcagcacgatggatttgatttcttcttttttctgctgaatgatttgatcaagcatacatttcttcctctttctgtttcagacgttcgagctgctttttggcatctccgttttgaatcgcttctaaggctgttttcgttccttctttcagatcgtttgcaagacctgccgtataaatggccgcgcccgcatttaaggcggtaatatgcagagcggatgacggagctttatttgcaaaaatattctgaatgagaagcgcgctttcttccgatgaactcacttgaatatccttcaatgaaccttctgcaaaaccgaattgttcaggtgaaacggaatattccagacgttcaccgtttttcagttcaatgatatcggtcggtgctgtgatggacagttcatctaatccgtcacgcgccgacacaagcatgacgtgtctgacatcaaattgttccaaagcgcttgccatcaggcgcgctttatcaaatgaatagacgccgatcacctgccgcttcacctgcagcgggttgctgagcgggcccagcagattaaatacggttcggaagccaagctcttttcttgcggcggcgacgtgcttcattgacgaatgaaacagcggcgcaaacaaaaaacccatttgtttcatttcaatgctgcgtttgacgctttctggagtggcttgaatggaaacccccagcttttccagcacatccgcgctgccgcttttagacgaaacggagcgatttccgtgcttggcaactttagctccggcggcagaagctgtaatcgccgctgccgtggatatgttaaacgtagaaatcccgtctccgcctgttccgcacgtatcaacgacatccgccaagccacccgccgtctgtgcccgcgcccgcatcacttttacaaatccggcaagctcctccgccgtttcaccccggtgggctaataccgataaaatcccgccgatctcagactgcgacatgtccccgttcatcatcatctccatcagcttttcggcttctccggttttcagtgtgcggccattaacgcacgattgcagaaatttgttcatccatcttctcctccccgccagaaaagatgtcttctgcgatttgaatcgtttttaaaagcgcccccgctttgttacagctctcttcatattcggcttccgggaccgaatcagcgactattcccgcgcccgcctgcaccgacgccgtaccgtttttgatactcatggtgcggatggtgatacacgaatcaattgacccgtcaaatccgatatacgcaatacatccgccgtaggtttctctggaagtcggttctaattcatttaaaagctgcatcgcgcggattttcggagcgcccgagagtgttcctgccgggaacgccgacatcagcgcatcaaccggatggacgccctgttttaaacggccggttacaacagagatgatgtgcatcacatgtgaaaaagaaacgacctttgtgaattccggaacggctacggaaccgtactccgcaactctgccgatgtcattgcgcgcaagatcgacgagcatgtaatgttcagctttttctttttcgtcattcatcagctcttttttcaggcgatcgtcctcttcttttccggcgccccttcttctcgttccggcaatcggatgaatttccaagtgcctgtcatgcacgcggatcagacgttctggcgaactcccgacaatgtctctgtcaggcagtttgatatagtacatataaggtgaaggattgacgatgcggagcaccctgtacagctcaaatgaatgtctggatatcggaatgtcaaacttttgcgaaagcaccccttgaaaaatgtctccggcttttatatattctttcagtttatcgacgccggccataaactcttctttcgtataattggatgtcacatcggcaaaacttggcgtgtcaaatgtttctttagaaaaaaacggctctttcatatctttcggttctgtcaaaataccgataagcttacgaagctccgcgcaattttctttaaaaacggcccgctttttttcctccgtctcccggccgttaagcgccgcatattgaataaaatgcacttgtttcgtttcgtgatcgtacgcgatgattttccggcagacaaacagcatgcatttttcgaaatctgtttctttcgcgtggctcggcacggaaggctcaatcaaaggaatcatgtcatagctcagataaccgacggcccctcccgaaaacgggatatcaagctcgggtgttttaatgcggaagctttcattcatccaatcaagcacggcttttaattctccggcttcaaacagcgtatgcccgtttggatcagcggcagtgaatgtgtgatgactctccttaatcgtgataaaaggatcaaggccgataaaagagtatctcgaccagcttgacgactcatccttgctttctaaaagatacgtaatgtttctgtccagtttttcaaccatctgaatgggtgtgatcgtgtcgaccgtaaaagtctctgcgattggaatggtgcggtgtgtcagactgtcctttaaaaataaagaaacatccgattgtaaattcatgattctcctccttacggtaaggagaatgagatgaagagtgagaggagtcttgcgtataagaaataaacccaaaagaaaggcttcttttgggcagaataaaaacgtgtttatctcagctcagctaaactcattctctgctaccctattctaaactcaactgttcaatatcttacttaccagctctatacacactcttgtgtatttctaagctttgtttatcgtattacatgtcagtattttttgtcaatgataaatccggccttaacacaacggctttttctaaatagacatgcttgatttcatcctgaggcatatccgtctgaaccgtcatcaggacacggatacacttttgcagagcgccggtgacatccatttcctgcatgcacgtcaccgggacgtactgccacccggaaaggcggcggaccgcttttgccggaaatacggaatggatatcaggcgtggcggataacaggatctgcacaacgtcttccggcttgcatccattttgttcaatgattttttcaagcagctgctgtgttttttctaaaatttcttgttcggtgtcttgttccaccgttgttgctccgcgaatgccgcgtatcatcatgctgtttcctccattcgccatttgttcagcaaattttcgagctcatcttttgaaagcatgcagtcccgcgcttcgcctaattcttttaacacgatgaactgtgtcatgcctccgcgcgtttttttatcattcatcatccgggcggaaagaaccggcgtttcaatatcttgtctgatgcttcccgggtagccgagcccaatcagccattgtgtgagttctttcctgttcatcttgcaacccgcaacctgttcactcacgtaaagggcaaactgcatgccgagggcgaccgcatctccatgagtaatccggccgtagccgtattccgcctcaattgcatggccgagcgtatggccgaaattcagaaaagctcttatcccctcttccttttcgtcctcacgcacgacggccgatttgattgaaattcctttataaatcatttcattcagctcagcgcttgtcagtccttgcaacgtgtcaaacgtgagaagcttttctaaaaaagcatgatcggcgataaacgcgtgtttgatcacttcagccatgcccgatctcagctcttgttctggcagggttttcagaagctccgtatcgtaaatcaccgctttcggctgataaaacgcgccgattaagttctttccgagtttatggttgacggccaccttgccgccgaccgcactgtcatgggcaagcagtgtcgtcggcatttgaatgaaatcaattccgcgcataaatgttgctgcgcaaaagccggtcaaatcacccgtcacgccgcctccgaaggcgatcatacatgaggagcggtccatatggaaagcgatcgcttccgtttgaatccgttcatactcttttagagacttcgcttcttctccgcttggaacgattacttttttcacgggccatgtttcgcttaaaagccggaacatctcatcgccgtaaagccggtcaacttcagcatcgatgacgagaaggatctttgtcagcggcctgttcagtgaagacaaaagagcagcggcctgtttccttatgccttcaccgatatacacgggatatgcggaggaagctgtccgaacctcaagctctttcatcagaattccctcgatagttttttcatgttttcaacattttctttaatgcggtcgatctggtcaagcccgaattgttctacgacggcatttgcgatttcccaggccactgctgcttcagccactacgcttgctgccggaaccgcgcagctgtctgaacgttcaatgctcgctgtaaacggttctttcgtttcaatgtcgacgcttttcagcggcttatacaaagtagggatcggtttcataacgccgcggacgacaatcggcattcccgtcgtcataccgccttctaatcctccgagcctgtttgtggcgcgtgtatagcctttctcttcatcccatacgatttcatcatgaacttcactgccgtttttgccggccgcttcaaaaccgatgccgaactctacgcctttaaacgcgttaatcgacagaacggcagcagcgagcttgctgtccagcttacggtcatagtggacatagcttccgacaccgaccggcataccttcgacgatcacttcaacgattccgccgatcgagtcaccgtttgccttcgcttcatcaatggctgccatcatttgacggcctgcttcttcatcgtagcatctgaccggtgattcttccgttacccgtttgagatcctcaatggatgtgtaatcggttttctctgcttttacgctgccgatttgcaggacatgtccggcgactttaatgccaagctccactaaaatctttttagcgacggctccggcagccacgcgaaccgttgtctcacgcgcggaagatcgttctaacacatttctcatatcgcggtgattatacttaatagccccgttcaaatctgcgtgtcccggtctcggtcttgaaatctggcgtttcatttcactttcttcttcttctgtaatcggtgcggcgcccatgatttttgtccagtgagtccaatctttattttctacaacgagcgcgatgggtgaaccgagtgtccgggcatgccgcacgccgcttgtgatcttcgctctgtccgtttcaatctgcatacggcgtccgcggccgtgccctttttgacgtctggcaagctcaaaattaatatcttcttcagttatataaagccccgcaggcacaccttctataattgtcgtcagctgcggaccgtgtgattctccggctgttaagtatctcatttctttcttctcccttcatcgcattaacgcttttaagtaaaactataccacaagttttcattaaatgtcttctatcttttttgataaaaaaatgtatcagtgctctcaaggccgaatttttccgggctgaaaatctgctctgtgcttccgacaaacagaattccgttctttttcagactgcccgccattttcacatacagttcttcttttgctttttcagtaaaataaataaagacgttgcggcagacgatcagatcaaaatcctgttcatagctgtcggcgagcaggttgtgccgcttaaaccggatgtttttttgaatctcttgttttacttgataactgttgtcagcctgcttagtgaaataacggcttttcacggaagccggcacctcttgcagcgagcgttcctgatagatgccccgcttggctttgccaagcgccttttcatcaatatctgtcgccaatatatcaaatccggccaaacccgcctgctgactgagaatcatggccaaggtatagggttcctcccccgttgaacaggccgcactccatatttttaacggtttgttatgctttattaacggaagaattgaggtttcaagaacttcccaccgtttataatttcggtaaaattcagaaacattgatcgtcattctgtccaatgtttcatttaataaaagcttgtctttctccaaagcggcggcaaattcctgaaaatctttgaatccctttttttcataaagggacgtcagccgccttttcatttgtgcttctttgtataaagataaatcaacaccggttatttgtttccacttggtgataaaaatgtcgtaaggctccattgcttctctcccaatctcgctgtcttttgtcctagtatagcctgttttctttctaatttgtacgatttcaataaaaaaatcagcccgcaggctgatttgtgagaaatgaaaagacagggcagcgcagcctctgtctttcttaaaatatgtaaaccttttcataacaagagaaaaagaaaggctgacggcttagtacacccagtcggccattaatttttgatacggtacaagctcttcctgtttgaagaaaatgtcaatttcccgctcagcgctttctaaggagtctgaaccgtgaatgatatttttgccgacaaacatgccgtagtcaccgcggatcgtgcccggcagtgcatctttcgggttcgtttttccgatcagctgtcttgtgatctctactacattttccccttcccataccattgcaaatacgggtcctgatgtaatgaattccacaagctcgccgaaaaacggcttccctttatgttcagcataatggttttcagccatctgttctgaaacttgcattagcttggctcctgccaattgtaagcccttacgctcaaatctggataaaatctctccgatcagctggcgctgtacgccgtccggttttaccatgataaaagttttttccataagattctccaccccatcattatgtataggctttcaagttgcacaccgaaatcgtaacatctttctgacaattaatcaatccagggcggagaatgttcacatcttgttcgtaaaaggaatttaaaatttccgtttgccgatatatttggcgatggcggccaatgatgagcgcgcccgtcctctcggcagtgtattcagtttctcaaacgctttttttaagtacctgtcactgacagccattgatttttcaatcgcgtctgtgcgtttaatattttcaataatgggggcgagctgctcctgtgttgtttcactgttaattaatttcagctgatttttcaattcaggctgacggagcgcgtacaaaacgggcagagtgacatttccttgcagcagatcccctccgaccggttttcccagttcctcttccgttgaagtgaaatcaagaatgtcgtcaataatctgataggacatgcccacgtaatagccgaaccaatataatgctttgtgaatcttctcatcagctcccgaagcgatggcgccgagctgacagctgacggcaatgagaagagccgttttccgtttgatgcggcgcaaataggttctgaggttttgttccatattgtatttatctctgatctgttcaatttctccgaggcatacttctacgatggttttggacaggatccggtgggctttcggctcatccaatctcgtcatcatctcaagtgagcccgcaagcatataatcaccggtatacatggcgatacggttgtcccacttggctttgatggtcggctttcccctccgcagctcggcgtcatcaatgacgtcgtcatgcacgagggacgccatatgaatcatttccagcgtcaccgcaacatattttattttattaatgtcatagtcgccgaacatgccggaaagcaatacgaaaacagggcggatccgcttgcctcccgcctggagcagatggagcccggcttcactcagcaagggatagtctgaccgcaccgtttgctcaagctccctttcgatcacatcaatatcgtcatttaaaaaagaataggccattttaaatttcatatcattcacccaaacatctgtatattcatcatttccaaccgatatgcgtagcggccactccgccggtaaacgaatggtatttgacattcgtcaggcccgcttcttcaaacagacgcgcaagttctttcataccgggaaattctcttgccgattcttgaagccaagaatattctttatagctcttcgcaaacatttttccgaagaaaggcatgatgtatttaaaataaagaaaatatgcctgtctgaatccgaacatttccggctgggatgtttccagacatacgacctgcccgcccggtttgacgacccgccgcatttctttcagcacggtcagatagtcgggaacgttccgcagcccgaagccgatggtgacaaaatcaaaagaatcatcagcgaaaggaagctccatcgcatttccgtgcaaaagttcaatttggctgtaaccgccctctttcacttttttctcgccgatgctcagcatatttttgctgaaatccagtcctttgatttcaccgctttttccggctgcttctgcgagggcaatcgtccagtcagccgttccgcagcagacatcaagcgcttttgcgccttcttttacattcatgatctgcatcgttttatcgcgccattttttatgctgctgaaaactgataacagagttcatttggtcataatttttatagattttttcaaacacgccgtgtacgcgctgttcttttgactcctgcatgttgattacccttcttccactttctgatgatatgttttgtcctggctgatcgccttaagccggttcagcattaggttttggattggtgaattgagcggcagcagcgtttcaatgctttgctttgcctttcggaagctatcttccattatgtcagcctttgatttccctgactttacaatattgccgatgacatcgagaaatatagcattgccgttcatcagccgcttatatacaaaaaaatcactcgccagctctttccagcgcggaagattaaagtggtctgacactctgtgaaacagggccgcttccacaatcgccatgctttcgatcaattgattcaagtcattgacagaccgatcgtacagacggattttatgctcattgatttctttaattgccgtagcgagcgtccgaatcatatagatatccttcatttcagataaaagcgaataatacagtccgctgaaatagtcgccggcaagcacggtgagctgccggtttttattttcgtctcgctttaacgctctggctgttgtcacttcatcgtgggtatcaagggcgctttggacaagcatcgcagttactatgtaattttctctgtcgttgttcttaatgtccgcctcttcaaacaaagcgtgaaaaagaagaagcttatcctcatcgattttaggcgcggaaatatgtttcgctaaataaggatgagacagcttttgttttaatttcgtatttagattcgctaaagttccgtagatgtcttgcaaaaatatcacccttgtccccaaattcacatttattctaatatgtatgagatttactcgtcattattatacgcaggtatcattatagcataaaaaaaagaaattggctgtattctcccgccgtttgcgggcatttggcaaaagcgggaaacagccggcttattttttttcgctgttcatttctccgtaagcggtctggatgagggcgttgcctctcactttgatggcagaggtatgctcagtaaactgagcgataatcacttcgcctttgtccagtttttcggaatggtgaaatttcgtatccgttcctctcgttaaaccgatgacgttcacgccgtcctcgaccgctttaatgacgacaaaatcacttgaatgctttgaattcatatctgcaccctctatcattattaatccgcacgtttaatatgttctaacacttcggaacgcgccgctgcgtcatctttaaaaatacctcttacagcggaagtcactgtttttgcgcccggctttcttacgcccctcatcgtcatgcacatatgctcagcttcgacgacaaccatgacgccgtggggatctaaggtctctacgatgctttctgcaatcgttgaagtaatgcgctcctgcagctgcgggcgttttgagacggcttccaccgcccgcgccaatttactcaggcccgtcactttgccgccgcgcggaatgtaggcaatatgcgcttttccgtaaaaaggaacaaggtgatgttcacacatggaatgaaacgcgatatcttttacaagaacaagctcctcatggtcttctccgaaaacggttttaaagtgttctttcgggtcttcatttaatcccgagaatacttccgcgtacatttttgccacgcgtttcggcgtatctaaaagcccttcccggtccggatcttctccaatcgcctctaaaatctggcgaaccgcctgttcaatctgttctttattaacttctttcattgtctgtgtcctccaccattgaatacatttaatttcgattctagcacatttgccgcgccaaaagcaaaacgaaagtcctgcccggtgaccggggctgcttaaatatgaaaagcccctttatcaaggggcttttctgtgaagaaacaaagtgtatgtatcagatgcatacacgatctatattcacaattattttcctgcaacagcgtctttaagagctttacctggtttgaaagcaggtactttgcttgcagggatttcgatttcttcacctgtttgcgggttacgtcctttacgtgcagaacgctcgcgcacctcaaagttaccgaaaccgatcagttggattttatcaccgtttttaagtgcatctaaaatcgtatcaaaaacagaatcaactgcttttgtagcgtcttttttagacaattcgcttgcttcagcaaccgcattgattagttctgtcttgttcatgcctttcacctcctcccaaaagggtatcaaatcagcagtttattatcatttcttcacagttcagcctgattctaaacctgtctgataaaaaatcaaagcagggaagaacagacaagtaaacggcttttcataagaaaacagacactttgaggaatgtttgtccaacaaagtgaagattttctgtatgtagagtaacacatataaaaagccatatcaagcattttaaagcctcaatcccttgctcgtcaaggttttcacgtgttttaccgaacaaatattcctttttttgcttttttcctcctaatccttgattgatttccagtatctaaaaagaataaaaaaagacccccgtttcaggaagaggtccttcagcttacaaaataatggcgatcaggccgcctgagccttcgttaataattctctcaagcgtttctttcagtttgtatctcgcattttccggcatgagtgacagttttgcggagattccttctcttacgatagagctcaatgatctgccgaaaatatcggaattccagatagaaagcggatcatcttcaaagtcctgcattaagtagcggacaagctcttcactttgtttttctgtcccgatgatcggtgcgaattcactttccacatccactttgatcatatgaatggacggagcgaccgctttcagccttactccgaaccttgatccctgcctgatgatttccggttcatccaggctcatatcggttaaggccggggcggcaatgccgtagccggtctgtttcaccattttcagcgcatctgatacctgatcatattcttttttcgcgtgggcgaagtcctgcattaattcaagcaggtggtctttcccgcggatttcaacgccgaccacttcttttaaaatctggtcatataaatgatccggcgcatacaaatcaatttctgccacaccctggccaagttcgattccggccaatccggcgctttcaataaattcaaattcactgaagtggccgacaacccggtcgacatcgcgcaggcgtttaatatcttttacggtttctttcactgattcctggtagctctctctgagccaatgattttctttcagcaccatgacccagctcggaaggttgacattgacttccagcacagggaactcgtaaagcgcttctctgaggacgcttaacacatctgtttcccgcatgctttcaacactcatggcgaggacaggaatatcatatttcgcgcttaattcagctctgagcgcttctgtttccgggtggtatggttttaccgagttgatgaccataataaacggcttgccgacttccttcagctcgtcgatgactctttcttccgcttccacgtaatcgccccgcgcaatatcgccgattgagccgtctgtcgtaatgacgaccccgattgtggagtgttcctggatgacttttctcgtaccgatttccgcagcctcatgaaagggaatcggttcttcgtaccaaggtgtattgatcattctcgggccgttttcatcctcatatcccttcgccccgggaaccgtatatcctacacaatccacaagacggatgttgacatcaagcccttccgcgacatgaacggacatggcttgattcgggacaaattttggttctgtggtcattatcgtttttcctgctgcgctttgcggaagctcatcctgcgcccgcgctcggtcggcctcattgctgatattcgggagcaccacaagctccataaattttttaatgaatgtagatttccctgtacggacagcgccaacgactcctaagtatatatcgcctcctgttcgttcagcgatatccttgaaaatatcgaccttttccaagtgatcccctcccggacttcctatccttatcatttttcattcaccattctccaatcaaatacaggacactatatgtgtatgacgttgtcctatttcaatatgacatctttagaaaattttcaggcagtcttttctatcaaaatcaaaaaaacctttctccctatttgtatgcgcgggaaaaaggttcattcctgtttcgtttgactttctaaaaaaacgggttcctgtttttcatttacggtgtatgtgactgaaaaggccgggacgaaaggagtctctttccataaaatatcctgaatttccgcccccggtttgattttctttttggtttccttcaggcagcgggcgagatcgacgcgatagtcggcatagatttctccgtcagcgccgattaaaagcggcagagacgtgcctgaaaccggacttttgaccgaaggagagtctttcatgccgagctttttttcatttaaagtgaacagcccttttgaaacggcgtcctcatagggaggatatgtatgcttttcctgatacattttgacacgcagcttcatgtcgcggattgcttccgccatttggagatcgaccagcttgacggtcggcttattttccacatcgacaagcacgtattggtacattcctccgctttcataagctgaggccggcggctcctctatgtatctgggcgcgagccgcttaaaatctatcggatatttttgatagagcggtgttttcatatcttttgtctgaatcggcagaagtccgccgttcgcctttttaaattcatccactgccgcttgcacctgctgaagctgatgtttgtaggatactttattttcagtttttttcgcttcagggtacagacagccggacagcagaagcaccgccattgccgttatgacggccatttttaacttatgcattccgcgccccctttttgctttattcattgacaggcccgctgaaaacgaccattaacacgatcaatcccgagatgaccatgcaggcataagcgagtgaagaaaccgctgcttttatcagtttgtttttcactttgtacctgctgacataaatagaggcgaccgcaacaaacattaatcccatagcaccaagcgcaaaccacattttcatcaatgccacactcacgttcgtgccccccgtcccatcattgtaagcgttatatttcattttaatatacaaatgttgaaaagatcaacaggttttccatctattgaaaaaacaaaaaaactgaagcaaagagggggactttgcttcagtcaagttgactatattcacctgtacgtctgagatacactctcttggacttcgatgctatagtatgcttagatgcgtacgtctgcatcctcttctgcctaaatcagcaaatgttttaagcgatttcagccggagagttctgcgttttggactttcgtcacttcagaatatgctgacggcatgttattgtcacttcacccggttttcgaatgtgttgaccaagtcttccatctcatgggttttcactctggccattaaggattctacggccgtttctaccttctgcccgttaaataatacttggtgaagcgcttctgtgatcggcattttcacctgatatttttgagacagctgatacgcagctttcgtcgtccgcacgccttcaacaaccatgcccatcttatccaggacagcttccagcttgtatcctttgccgagcaggttgccggcgcgccagtttcgggaatgaacgcttgtacacgtcacgattaaatcgcctacgccggtcaggccggaaaaggtgagcggatttccgcccatctttgtgccgagtctggcgatttcagcaagacctcgggtgattaaggccgcttttgcattatctccgtatcccaatccatctgtaatccccgctgcaagagcgatgatattctttaacgctccccctatttcaacaccgatcatatccggatttgtatagacgcggaaatgctggttcatgaataaatcctgaaccgcttctgcagccttgatattttttgaagatgatgtaacagtcgtcgggtgtcttaatccgacttcctcagcgtggctcggccctgaaagcacgacgatgtcttttctgtactcctcaggcagctcctcttccattaattctgaaatgcggagaagcgaatccggctcaattcccttgctgacatgaacaaaaatcgattgtttcgggatgtacggcagagcctttttcagcacttcccgaatggcttttgtcggaactgccacaatgatgaagtcagctccttttaaagcctcgcttaaatcggctgtcccgatgatagaacttgatagctccacacccggcaggtaatctttgttttcatgcagttcgttgatttgatcgatcaattcggcacggtgtccccacatcataacttgatgtccgttatcagccagcactaaagaaagtgcagtgccccagcttcccgctccaagcattgccacttttttcatctctgtatcacacctttttattttcttgctcttgcaaatattttaattggcgtaccttcaaatccgaaagcgtcccggattcggttttctaaaaagcgttcataagaaaaatgcatcagttccggatcgttgacaaaaacaacgaagctcggcggcttaacagcgacttgagtcgcataataaattttcagacgggagccgttgtgcgtcggagtcggattcatggcgaccgcatccatgatgacatcatttaagacatttgtctgcacgcggagagagtggttttcactcgctttaataatcgcaggcatgagtgtatgaatccgctttgtcgtcagtgccgacataaacagcaccggcgcataatcgagaaattggaaatgctcccgaatattctgttcaaattctttcatcgtgcgctcgtccttatcaacggcatcccatttgtttacgataatgacgacggctttcccggcttcatgggcgtatccggcgatccgcttgtcctgctcaaggatgccttcttctgcattcagcacaacgccgacgacgtctgagcggtcaatggcttttaacgcccgcagcacactgtatttttctgttgtttcatatactttacccttttttctcattcccgccgtgtcaacgattacaaattcctgctgattgtaagtgaacgccgtatccacagcgtctctagtcgttccggctacgttgctcacgataacccgctcttcgccgagcatcgcattgacaagggatgattttccgacattcgggcggccgatcaggcagaattgaacgacatcatcactgtacttcgtctccggaatgtttttaaaatgctcggcacaagcatcgagcaaatctcccaatcctaaaccgtgtgtacccgaaatcggatacggttctccaaagccgagcgcataaaagtcatagatgttcgctctcatttcggtattatctaatttattaacggctaatacgaccggttttttcgtccggtacagtatttttgccacttcttcatccgcagacgtcacaccttcgcggccgttcaccataaagatgatcacatcagcctcgtccatggcgatttcagcctgctggcggatctgtgtcagaaacggttcgtctccgatatcaattccgcccgtatcaatcaggttaaaatcataattcagccattccgccgaactgtatatccggtcccgcgtcactccgggggtatcttctactattgaaattctttcacccgcaatccggttaaagattgtggattttcccacattcggtcttccgacaatggctacgacaggtttacccatagtacccttcctttcaatccagccgcttacattttcacaaaaaattgttcaaccggttattaaaaatcatcttcgctatgaaaagaacccttcaaacagaagggcttaactcatttattatatcagttttcactgagatcacaatgtattcttcaaaatgtttcgcattcatgtaacagtctccgtctgttttcaagacatttttgtcgctcctttgccctgctttttgcttttttggctgatgcgcgccgcaagctgttcatatgtagtcagcccgacgagaagaatcactcccgccgaacagcctgaaagccatttataatcaccgacggctgctgcacccgcaatgttgcggatgaccgcagcatacaataactccccctggcacatgccgagaacaaaaagacaaagcctctcagggaaccgcccctcaacagaaagcgtaataacggtaagcagtataaccgccgcccattcaggttttatgataaaccaaacagggtcatataatgcaaaaagaaaaataaagccgtatgccgcagacgccgtcagatgaatcacaatatgacggagccgtttatgcatgccgaggcttcccgcatatacaaatgccgcagcaaaaaacatgacatatgccgcgttcagcgtaaaataagccgttatctgatgtatgcttgccatcatattagtcaaaataaagactgatacgtaaaaccggctttttgttttggcaaaaataaaagtcgcaagtatccataaaaaccacattgaccagtaataataaaacggttccataatcgctcctcctctgaccagtatggagcgggaacgcattttttaaaccaattatgcctgaaaggagcggataaggatgggaaaagacagacaggagaaaaaactgaaagcctcccgccgggtggaatctgatcgcgatgattcgattcaccataaaggagcgacaagccttgaacaaaacggtgaattccgaaaaagaaaatcgtaaaaaacagaaaaaggcatgcgagttcgcatgccttttaacgtctgctgaaacgggatgtgtcaattccccgttcagaaagccagtgatgtgtgtcaccttttatgaccaaaggcgccttttgcaattgggcaaccgattggcatccgagggcggtcataatcattttcagctcttgtaaaagcgccgtcatctcgtcaaacagcccctcttctcctttggaggtgagagctttcaggaaagtgcctgccattcccgcgccagaagcgccgagggcaatcgatttggcgacatccagggcactttgcagcccgccggatgcgataattgattgatcagcggagagcgagtggatttccgctaagcttgcggcagtggaaattccccatgtattaaaaaattgaagcgccttctctctgcgcatattttcaatcttagagaaatttgtaccgccgtatccgccggcatcaactgctgccgcgccggcatcaaataactgccgtgccgattccctgctcattccgaagccgacttctttgacaaaaacgggaactcccgcttccgccgcaatccgctcaatacggccgagagcgccggtaaagcttctgtctccctctggcatgacgatctcctgaatcacatttaaatgaatctggagggcatctgcttgaatcatatcaattgcccttttcgcctgctcggcatccgcctcgctgcctaaattggcaaatatcagcccgtccggattctcttttctgacgatctcgtaagaataccgttcggagggatcttttaaagccgacatttgcgaaccgacagccagcggcatgccggctttgcgcgcggctcttgccagcgatctgttaatttcgtatgtaagctgtccgccgccgcctgtcatcgcattgataaaaatcggcgaactgcttgtgagtccgccgattttcgttgatatatccactttttccaatgctaggttcggtaggctgacatgaacaaacgtaatatcatcaagccccgtttcccggttttgaccggtagacagcgcatgatttatatgttctctttttcgttctgctcgtgtcacgttttatcaccaatttattttaatttattaagcttgtctccgattaaatcgccaagctggaagccggtgctcggctcttctttcgcctggtattgacggaagtcctcctgatcggctttcggcgcttcttcaagctcacgcatgcttaaggaaatgcgctcttcgctttcgttcacgtcaagcactttcactttaacagtctgtccttcttcaagcacttcatgcggcgttccgatatgtttattggaaatttgcgaaatgtgcacaagtccttccacgcccggaagaatttcaacgaaggcgccgaagcttacaaggcgctgcacttttccttcaagcacatctccctgttttaccttttcgccgatctggctccaaggtcccggcagcgtttctttaatagataaagaaatacgctcattatcgcggtctacggacagtactttcacttttacgtcctgaccttcctccaccacgtcagacggtttttcgacgtgtgaatgagacagctgcgaaatatgaacaagcccgtcaattccgccgatgtcgacaaatgcgccgaaatcagtcagacgctgcacttttccttcaagcacgcttccaacctcaagcgtttggagaaaatcatgctttttggctgtctgttctttttccactacagcccggtgtgacagaatcacccggtttttatcacggtcgagttcaacgacgataagagagagggttttccctttatagtcagtgaaatcctcgacgaaatgagcttcgacaagtgatgcgggaatgaagccgcgaacgccgatatcaacgacgagaccgcctttcaccacatctttcacttcagcttcaaacacttcttttgtgtcgaattttttttcaaggtcttcccaagcgcggtcagcatcaacggcacgtttagataaaatcaaagcatcgtcttccacttttgttactttcaggtcaagctcgtcgtcaacttttacgacatccgatgctttctctacatgaagacttgataattcactgattggaatgattccggactgtttgacattgacaatttcgacatctacatgcttgtcctctacctttgtcacaatcccttttactacatctccaacctctggcacttgaacatcaatttgattcatttcctctgtcatttgaataacctccttggtccaaacctacacagcttaattaatacggtttgaaagttgaacatgtgaatgtccgcttttcagccgaatatgtattaaagaatcatccaaaaaagattttgaatgatcaataaaaagttttattagtattaacttctaataaaaggactggtttgtcaagcaataacatcttgtcttttgaaaaaaaattaaaaagcgctccgcccgaagttaacgtgatttctgttcgacgatctccagaatttttcctgcgacttcggcaatgctgagtgacgtcgtatcgatttcaatcgcgtcttccgctttgcgcagcggggaaacttccctctctgaatcgagtttgtcgcgtctggcaatttcttcaatgagcgtctcgtaattcacgtcatagccttttttcttattctcttcatatcggcgcttcgctctttcctctacggacgcgagcagaaaaattttcacttcggcatcaggcagcacgtgagtaccgatatcacggccgtccatgacgacaccgcctttttgtccgagctgctgctgtcttttaaccatttcttctctgacgcctttatgcttggcggcgatggatacttggttgctgacttcgtcttttcggatttcttctgtcacatcttctccgtttacgagaacgatttgtccttccggagcggatacaagctcaatttccgtacgcttcaaaagctctgtaagcgcggcttcatcggttaaatcggcattctgcttgagcgccgtatatgtaatggcacgatacatcgcccctgtatcaatgtacacatatgattttttctcagccactattttagcaacggtgctttttccggcagcggccggcccgtcgatcgcaattgataatttcttgtccataatctctctccttgctctttactcctctatggattgtatcatgaactgccggaaaaggggcgaaaaaattgagcagatttaccgctttaccgtttcaatccattcttttttctccattttatcaactccctcatatttcacggctttcgaaatataaggttcaataggctgataatgaagcaaaaactgcaccgcgcccaaaatgataagctgaatgcagaccaatttgaccagcagacgttcaaacgttttcatacacgcgcacctccattaggattagtatggaaaagtgcgctgctgtttattccgacagactgtttcttctctgctgcagctgcgcgcgcatacaatattggagtaaaagctgctgcgctgcggggccgatttctgtaaattcaagcgtcattttttgtttatccgccttttcatcataaaaaatccgctgggtaagagcctcagccgttatatccgcctccttttccttgccgggaagagaaaatgagacatacagcttttcacctggttccgcggaaatatgctcaggcatcacaacagcgattccgccggcgctgatattagaggaaacagtttggaaagcggtttttttcgcttccattttgacagatacatccaatactgcttctgcacggacgtatcggcgtctttgaatccgcttcatttccttctgagggggatgtccaatccgatcatcgggatgggttcttttttctttcctttgattatgcttttaaattgatacggtacttggccattccccataaattccgctgttatttccaatcctttatgcaaaaagaccgtccgtcccgaatccagatcgacgggatatgagatatggagttcgccgttttcaacgcttactgctttgctcctcgcttttttgggctcattgttctctatgtattcaatccaaatataatctccgacagctatcatgggccttcactctttcattatttatgcttttattaaagcatgtaatgaaaaaaaggaaaagacttttagtcctttcctcctttatttttataggtctttatatataggctctgcactttttaatttttctattttttcctcttttccgtcgtccgcattaatgaacatttgatacgtgtctttcccgatcgtcccgagcatttcgtagcaaagcacttcctgaccgagttcattcgtgatcagcgcctgccgggtctcccgcacttcaacatttttattcagcttcgctttcgcttcatcagctgacaaagcgggagccggaatcgttctcgtgcggtgcgccgccaggtaatcacgcgcggaaaaaccgacgacttcaccatcatccagcgccactttcattcggatggcttccggataaatgcggacgtttttctccacgggaataaaagaaaagacgccgatgttattatattgcgcgctttcatcaatttcgaggccttttgtttcatatccgtttttctttaaaaacgcgacggcccggttagatgcttcattgaggctgatcttttgtttcttcacgccccgtttttgaatcaaatagacaggatgtccccctttttgggtaatatccatatagataaaagatttgtgatccgcgtcattcatgcggatactgtatacatcccgattcgtcttccggccgcttttgaccactttaatggaataattatgatcaggcgcaaaccgttccgcgatttttaccgcttctttttccgtaatttgttttcctttcagatgcgtaaacccttttcgttctgtatttgcgcttgtaaacgtagggctggtactgtcttcagaaaaagcgcctacatttttttcgactgttttaaagctgtcgacgatcgtattatcgctttgttttttgtcagaggcgagcgccatctcaacatccatccaccgtaaatttttgctcatgacgagatgctgaacgctgcggagctggttttgaatgttctcggcctgtttgtacaggctgttcagtgttgtatattctttcttatcaagcggtttttggtctaaatcccggacggatgttttatagctgaaatctcctatattggataaaaactcctccgtcttattaaaaggcatgagagtcaggggcagctggctcacattgttatgtgcttcagatgtaattctccatacatcaatgagcgccggagacagagattttttactgttcattgcaagcgtcgtcccgattttgtcgtgaagctgatcaacatggtacgtcagttcatgaaaagccctctgataattattttccgcgtgcagaaggaccgcatctttttcctgatgctctttatatccccagtatccggttgcggcgatcgcgacaccgagaacagcgataatgattcctctaatcatgttaacacctcattttgcgtacttttactcacagaaaatgtgctttccgattcttttaatctgcggacgtccccaaatccatttgcttgtcgccgtatcaggattgaaataataaagcgcgttttcagaagggtcccatccgttgatcgcatcaagaaccgcttcttttgctctttcattcggctgcatgtatatttggccgtcggcaacggcggtaaacgcgagcggttcgaaaatgacgccggccaccgtattcggaaataacgggcttttaatacggtttaaaataaccgcggcgatggcaacctgtccttcaaacggctcaccgcgcgcttccccgtacacagcctgcgccagaagattgatgtcgttgtttgagaaaccgccaggcatattggccgctgtcgtattttgcttttgatttgactgaccgcctgtattgttttgcggcttttgagcaggcttattcgttcccgccggcttctgcgctccggctctcggttttgtttggttttccaatgggacgttgccataatgagtgaacgtattccctttttggatctgctccattacatattcacggtaatattttgattttgaaatcagcacctgtttggttttcgccccgacgaggccgtcaaccggcttcatgccgaatttctcctgaaaatttctcacggcccagtatgtggtccagccgtaaacaccatcgattttcccgttataaaatccgttatattgaagacgggcctgcaattctataacatcatcacccgtcgcgcctctttgaatcacttgatttgaaaacgcatgaatcgtttcatgatgatcgaagaaagcggcggcgaaagaaaatagaatgagacatgccataaaggctcctttgcacttcatctcttcaagcctcctactgcaaaatttaaagtgtacccgtattgtctgtcacgcggatatttttatacaccgtttccttcttatccctcatcaaggcataaaaaaagaaaccgcacgcgatgcgcggtttcttcacacttggatcatattgacggagcgtgctttttttgcctttcgcagcccgaaccaccataaaaacagcataaacggcagcatataatatacccaatgattgagggcggtaagaataaaatcgtacgaaccgtgcagacatgaaggcacggccagcgaaatcacaagccatttgacacgggcttttttctgcgaaaagcgggcttttccgagataaaaccccataatcactccgatcagcgcatggcaggagaccggcagaagcgcccttatgaaagcatgctcaacgccgtggccgaataaatacagaatattttcaagcgtggcaaagcctaaagacacactggccccgtaaacgattccgtcataatgctcatcaaaatgagcatgcgggtacacacttatcatcagaacgaaccatttcaccgattcttccaaaaatcccgaagacaaaaacgaaacgaaaaagcttcctccccccacatgctctttttcaagaacatattggataaacatggtcggaaacacaaggacaaccccgagaaaaaaagacctcagcaccatatgtacgggttcattgtcatactgatcttttaaataaaaatagcttaacagcgcaatgccgggagcaattcctgcagagatgattgcaaacatcaggcaacctctttcctttatattcctatatctatggtaccatgttgttcatatttttacatctttcaatttttttaaaaaagagcatatgaatgatcatatgctctctgcacccagccgttttgatatttcgtttgcgatcaagccgccgtgaaaacggccgttctcgataaaaatttcattggcgttatttccagccgcaatgactccggcgataaaaacaccgtcaacatttgtttccatcgtttcttccaggaaaaacggccggcctgattccgcatcaatccgcacaccgattttttcgaggaaaccgtgatcgggatggtatcccgtcatggcaaatacgaaatcgtttttcagccggaccgtctcatttcggccggagcggaaaatgatttcatcttccgtcacttcttcaagacaagcgccgaattccatccggattgtgccgtttctgacaagggcctcaaactcaggcagaatccatggcttgatgctcggggagtactcatgtcctctgtagagcaccgtgacgcgcgcaccggacttcacgagttccaaagccgcgtccacacttgagtttttcccgccgatcacagcaacatctttatcaaaataaggatggccttctttaaagtaatgaaataccttaggaagcccttcacccggtatgttcatataattcggatgatcataatatcctgtcgcaatgatacaaaacggagtgaggtagcggtcttttgacgtttctacaagaaaacggccgtcttcctgtttcgttacgcgctccaccgtttcaaaggcgtttacgcgcagctcttttcttctgacaacctctctgtaataagagagagcctgtattcggaccggttttctgttttccgtaataaaggcaacatcgccgatctccaatttttcacttgaactgaaaaaagtttggtgggtcggatagttataaatgctgtttacgacattccctttttcgatcacaagcgcgttcacgccaatttgcttcagatgtatagccgccgataatccgcaaggacctccgcctattataattgctttttcttctgtcatgtccttcaactcctgcgattggcatttccatcataagtttccactcatataaaaaatctcctatattatcataggagattttttttgtttatgcaaacgattggtttatatccagcctctgaaacgcgaagcctcagccattttccgcacgccgaccatgtaagccgcaagcctcatgtcaatccggcggttttgggacatttcataaatattattaaacgattttatcatcatattttccagtttttcctcgacttcttcttcactccagtagaagccctggttgttttgaacccattcgaaataagaaaccgttacaccgccggcgctcgccagaacatcgggaaccagcagcgttcctttgtctgtcaggattttcgttccttccagtgtcgtcggtccgtttgccgcttctaccacgattttcgctttgatgcggtcagcgttttcttctgtaatttggttttcgatcgccgccgggacaagtatatcacagtccagctcaagcagctcctgattcgtaatggtgtcattgaaaagcttcgtcaccgttccgaagctgtctctgcggtcaagcagataatcaatatcaagaccgtccggatcgtaaaggcctccgtacgcgtcagaaattccgacaactttcgcaccggcgtcatgcataaacttggccagatagctgcccgcatttccgaaaccttgtacgacgacgcgcgcgttctgaatatcgagaccttttttcttggccgcttcttttatgcagatggtgacgccttttgccgtcgctgattccctgccgtgggatccgccgagtacaagcggttttcccgtaataaagccgggtgagttaaattcatcaattcttgaatattcatccatcatccaagccataatctgtgagtttgtaaatacgtcaggtgccgggacgtctttagtcggtccgacaatctgactgattgctcttacatatcccctgctcagcctttcaagctctctgaatgacatatttctcggatcacaaacaattccgcctttaccaccgccataaggaagatcaataattccgcattttaaactcatccagatggaaagtgctttcacctctttttcagttacattcgggtgaaaacgaatgccgccttttgtcggacctacggaatcattgtgctgcgcacgatagcctgtaaatattttcacagacccgtcatccatccgaacaggaattttaaccgttaataatctgagcggctctttcagcagttcatacacttcttctggataccccaatttttccagagctttatgtattacggtttgggttgattttaatacatcatgtttgtcttcttcattatgaccggtgaatcgatcggctgccatttgagttaacctcctaaaatcttctgtttctctcatgctccctttcagtgactagtatacaccttcaatatctccgtgcatagaagaaagacaatgatttttccattatttcgcttaaaaaaagacggccgctgaaaacagctgccgtttcaaatcttttttatgaaaaatgtttctggatggtctccacagcattgccgtccatgatgagttttccgtactcatggagcctgtaaatcgtaatcgtcgccgggtgtccgtattcagccagcaccgcgatgacaccttcggcggaacgggagccgaggtcttcaaggcttacatagtattggttctcatagtggtagacggtgccgccggtaatcccgattcggtgaaggcttccggctagctgaatgatatcttcaaacgaatggaactgataaataatatccgggctttcgtcaagtttgacctgcatctcgatataatcatcgtcatattcgtcatcttctgcatccgcgtcatgatttttcgttacaatcacaaccataccttgtgcctgaagagaatatacttccaccgcgatcggaccattcgcttcaaagccgagctctgtatttgcttcattcatcatatctttaaataactggtggactttaaacgagtccttccagaggtcttcttttgtcagtccccgatcagtcagatcgtcgagggttaaaaagattttaatcttattatagttcagacgctcaagccgcataatgttccctcctgcctcttcttgcacacaaatcatataacacagtatatgaataaatgagtcataggttcttaatttgttatcagtttacaccgtgtacagcgggaagacaagcagaatgccgttttttatcaccgcggccgggttgtttcaggaaaacggctcatccggtccgcacagcgtaatcatatgcgtctccggcttcgccccgagcctcagcggaacttttgtcgtcccgtagccgttgctgatcaggtaatgcgctttttttaccgttcccgtcccgcccaattcatacggcccgaaccggccgaaacggatttggccgccatgcgtatggccgctgaacacagcgtcaatcccgtctgactccctcatctgctcatggatgtcaggattatggcaaagcaggaggtttactttgtcagcatccgtatatctgattgcagattcgtaatcatccatcatcattctgatatcatccaccccgcagatcgtaacggtttcccctttataagcaaactgaaccgattcatttctcagcggaatcactttgtatgcccgtaaaagtgagagcaatttttgctggctgacctcgtaatcattatttccccacacataaatgacaggcgcgagagccgtcagacgtttgatgttttcttcaattctggcgtaaggaactccgccctccgccaaatcaccgccgagcaaaacggcatccggcttataaactgccgcttcgcggagaagcttttcatcaattaaacggcggtgcacgtcagatataaagaagatggtgagcggcttcatccctttcattttatcaagcgtaaatgtatgtgttttcaaatggctgccgtttgccgttttgtacatgacggccgccataaccgcagccgctcccgccaatgtgccgagaattcccgctgtaagcttcataaacgcactctccattctgtcattgtcttacattagacggacaaacaaaaaaagacgtttctatcctttccggaaaacgcctcattttatttgctttcaaaataaagattgatatcataccgatgtttcatcaagtaaaaaacagattctctcgccctccatttttcaggctggggccataaatccgtgcttttttggataatttcacatctcagtttatgaaattcaccctcagctttttcttccttttttttaaaataataagaagtgcaatacgcaaaagcggaagccataatccagcacaaataaaccgtatggcctaatatttcctgcaggatcagctgcggagaggcttggggggcgttaaagcttttaaacatcagcagtatgcacatcagggaaaaacaaacgagggacgcccactgccatcttcggcactgtgcggcataattttcgtattttaatttccgtttcaccagcgcctgaagcatttgtttcgtcggtccgtcagcaaatcggtctaattgcttccataaagaatccatgcgcttcacaccttgtccgttttcattggtacactatatgaaaaacgcggtgaaaacatgcatttattttaatcagacagcggaatgttcagaacctggccggtgtacacgtcgtttccgtttaatccgttgtagctgcggattttttcttcgcccgcccggcttttataatatttcattgaaatgcggtaaagcgtttctttcggctgtacagtatgctgtacggtccgcacttttttcgggacagtcccggcttgatcacttgcggcagccggagccgctttttcacggacagccggcggagactgctgttttgtctccgcgtattcggtgtctgtcggctttacttgtttttctgaggacgtttccgttttttcaggtgttttttcacttggtttttcttttgttttttcagatgcagccgcttctttcttatctttgtcgtcagacttttttttcggttgttctaaaagagcggtttctgacgtttctttctgagcgcctttcggaataacggcaggcgcgctttcactgtggtctatgaagacatcttcatagtccttcgggtcaaatctgctgctgttcgtcatataaagaagaccgaaaaagacaccgattgttacgataatgaacaggacggtcagaaaagtgaacagcggcgtttttgttttggttttttccttcacctgctcttccttttttttacgctcctcttttacagattgtcttgtcgggaggctgtcttcaagatattcaatttgttcatccgcggccgcggcaacctgctgctcggcacgcagctgagcttttcttctttcaactcttgacatttccgtcatagaaacccctcctaacatattgaaaacggatctgacaggcaaataccgcatcaataataaaatgcgctgtaaccggaacgaataaattgccggtccattcatagataagccccagcaaaagactgatgcccgcaaccatcataaacagaagccacttcgccaagtatctgaaatgaagcacggtaaaaatgaagctggcggcccataagccgatatgtgtctgcagaacgcctctgaacaaaatctcttcgctgaacgaaatgagaagcgtcaaaaacaaaatgtgcagaaccggcctgttcttaaaaagcaatacattaatgccgccgtcatcatataaatgcgaaggacaccatttcatcaccgccagatcggcaaaaatgacaaggacggcaagagttacaccgtaccatatgatattatcgtcacgtatatgccacagctttaaaaaatcgtgaatgtcggtgaaaaagaaaaagccgataacagctgaaaccgccaatatgagcaattgggtggcatacagctgtatcacaatctcccggtctgagagctgctggatcaattcgctttgccgtctcagctgaactcacccgcagactctgaaccgaaaatccggcctaattccagcttccaatcttcaaaccgttccatgtttttccgttctcctttttgctcgtacggagccagatcaagtccgcagctgctgcagcattgtccggtttggccttcaggctcatacgattcatcaaaataagacagcagcgcttttcttatacattctttccgctctaataacgccgaaaaacggttcattttacgcagcttcttttccacgcggtatgtcagttcttcctgcagctgctcttttgtggtttttccttgcagatacagatggacggccgttcgcgcctgtgtttcctggacgcctttattgatcagaacgtcccgaagctttcgctcatcatccgtaccggcatcccgtatgacggccagaatgccttccagatcataatcagacaggctttctgtctgaataatctgctgctgaagctcggtatcgccgggcgccctcagcaaaatactgacactcgggctgccgtcgcgtcccgctctgccgatttcctgcataaaggcctcagccgtttggggaggataaaagtgaatgacaaagcggatatctgacttatccacacccatgccgaacgcattggtacagcagatgcaatcaagctggttatggataaattgctgctggatcaagattctgtcccctgtatccattccgccgtgataataatccgtccgctttcccgttttttcattcagctcagccgcaagctcttccgcccatttcctggtcggacaatatatgataccggggccttcaagcttttcggcaagctccgtgagcctgtttattttttcggcattatcagccaaatgttctgccgccaggagaatattcggccggttgactgaataaagatgacgcacagcatgctcaagtccgagcacatccgtcacgtctctgagcgtttcttttgtcgctgttgcggtcagcgccaatacaggcggctttccgagtgcctgtctgaaaggcccgagcttcgaataatcaggcctgaaatcatgtccccattctgatatgcaatgagcctcatcaataacaaataaactgaccggaacgtttttcaaacggttcagtacataaggtgaagaaagggcttcaggagacatatagagaaatttataccggctgatgttgctgagaataaaatgccgctctgcggaattcagcatgctgtttaatgccgcaacccgcttttctccttttgctttcagctgctgcacctgatcttccattaatgaaagaagcggtgaaataatcagcaccagcccgtccatcatgtaacccggaagctgatagcataatgatttccccccgccggtcggaagcatggcgatcgtatcctttttttggagaacgctagtcataatctcttcctgcccttttttaaaggaatgcaaaccaaaatacctggataaagctttatgcagctcagtcatgctgattcaccgtctttgccagcgccagcctgatctggaaatagctgaagcgcatctgcattccttcgcgaatccgtttaattttattcgtttgatgctgttttgcaaatgccgttatcatacgctgttcctcttcagaaagatactgttctataaaaaatgcaggctgatgcaatgatatttctacgatatggtcttcgattgtggcggtttttaaatttctgaccgcggcgatccgttcaatcggaaaccctttttccaacagctcgaaggtttttctggcagactgtgtcagcgcgctttccgcctgcagatcggacaacagctcgcgcagagcgggatatgcacattgcggaagcgattgaataacataatgtaccgctccccaaaactggacggacacataccattcatcttcgttcagctggagagcgagctgcttattcgttttgccgattctgttgaatgaagttaaagaatagacaaaaataagcgcctgccgttcacttacgccatgcagaagctgaaacagcgcgtcatgcatttggacggaaagctctttagcatctctgtttttccgcatgaaccgtttgacccatctcagcgtctgcacatcgttggtaaccgggatatattgactgcattgatgctctttgtttgacaggacttgaatgagcagggaaagccgcctccacaggatgacggcaggcgtttgataatttgcgccgtggcagtgcttcggccaaggccgctcggcaaacgcccgttcaagcctttgaacgccgcgcgcagtcactttccacgttccctcttcttttccggctgtaatgtatgagttctcggtgagtttatgcaaagaagccgcaatatcgccgcgttcacactgtgaagccatgccgaaatatttagcgatctgaaataagccggcatcctgaatggtttgagacgacttttttccttttaataaatgaaacacagcactcggagtccgttcgccgtctattttgtccagacagtcgagaaccacggtatcaaagtagtttatcgccaatctaaacacacctacatttcttttgtgacaagtttcgttttttggttctttttattttaacagattttcatataaatttgacgtttaaagtcatcttttagggggaagtgctaaagagaatcccttatgtgataagcattctcaatcatttttctgttgaaatttgacactaacatcattacaataagtaagaggaataggtgttatatttaaaaatatataaggtaaaccatttgttccaacacgaacaatctgggaggttttattcatggcaaagtacacaattgtagataaagatacgtgtattgcatgcggcgcctgcggagctgcggcaccagacatttatgattatgatgatgaaggcattgcgttcgttacgcttgacgaaaataaaggtgtcgtcgaagttccggaagttctggaagaagatatgattgacgcatttgaaggatgccctactgattcaatcaaagttgcggatgaaccgttcgaaggcgatccgctgaaatacgaataaaaaagccctccccgtgagaggagctttttcgtcctgaataagactccggctgttatcggccggagtcttatttttttgccgatcagcacaaacaaaaaaagcgcccggctgttcttcacagagcggacgctttaagcctttattgtgtttggatgctgcgtttttgttcaatccaaggtttcagcttcgtaaagatgaacgtaaagacgatggtgatgataatgccttttacaatgttaaacggcagaattcctgcgacaaccgccgttttcaactggctgtttgacaatgccggtgaatgtaaaaaccaagtatacgcgggcaggataagaatatagttcaaaatactcatcagcacggtcatcgccgcggttccggccagcaggctcactgcaagcccttttgcagaattaagctttttaaacataaacgccgtcggcagaataaacagcgttcccgcgataaaattggctgcctgcccgacaggcacgccggccatgcttccttgaatgatatactgcagaatatttttaatcgcttcaaccgcaatccccgccgcaggcccgtaaaccaaaatggcgataattgcaggaacgtcactgaaatcaattttcaagtaatccggcagccccggaaacgggaaatttaacagcataagcacaaacgcaatactgctaagcatactgatgacaactaatttttttactttcacaatgctctctccttttcgatcaaatctctcgaaaagtggaaaggttctttgcgccccaataaaaaaaccgcttttgttaaaaagcgggagcttactaaggcttggcaaagaaacgtttgatataagcatcaaaacgtctgctgaacctccatcttctcccatccagactatactgtcggctccggaatctcaccggatcctgccgccgaagcagctcgcgggcttagagcgtgatgctcatcaccgccggtagggaatttcaccctgccccgaagattgatcttatgaatttattcacattatatatgatcaaattgtaattgtatagagaactgctcaattttatataaaatattgatgaagcccattttaactgaattatcggcttccttttctcctttactgcgtcaatacacattgacactctattaagaatatgataaattatcagatatttagtcagctaaactaggaggaaatctaacaatgtttcgagttttggtctcagataagatgagcaatgacggcttaaagccgctgatggaatcagactttatagaaattgttcaaaaaaacgtcgcggatgcagaagatgaattacatacctttgatgccctgttagtccgcagtgccacaaaagtaaccgaagaattgtttaaaaagatgacttctttaaaaatcgtcggcagagccggtgtcggcgtagacaacatcgacattgatgaggccacaaaacatggagttatcgtgataaacgcgccgaatggaaacaccatttcaacggcagagcatacattcgcgatgatttcttcattaatgagacacatcccgcaagccaatatctcagtaaaatcaagagaatggaaccggacggcttttgtcggagcggagctctacggaaagactttaggcattgtcggtctgggccggatcggaagcgagattgcccagcgcgccagagcgttcggtatgacggttcatgtattcgatcctttcttaaccgaagagagagccggcaaaatcggcgtaaacagccggacattcgaagaagtgcttgaaagcgcagatatcattaccgtccacacgcctttaacaaaggaaacaaagggactgcttaacaaagaaaccattgccaaaacgaaaaaaggcgtccgtcttatcaactgcgcaagaggcggcattattgatgaagcggcgcttttggaagcgctggaaagcggccatgtcgcaggcgctgcccttgacgtgtttgaagtggaaccgccagttgaatcaaagcttcccgaccatccgctggtgatcgccacacctcacttaggcgcttcaacgaaagaagcacagctgaatgtcgcggcacaggtttctgaagaagtgctgcagtttgcaaaaggtctgcctgtcatgtcagcgatcaacctgcctgcgatgacaaaagatgaattcaaaaaaatccagccttatcaccaaattgccgataaaatcggaagtctcgtgtcacaatgtatgaaggaacccgtcaaagatgttgcgattcaatatgaaggcaccatcgccaaacttgaaacatcatttattacaaaaagcctgctgtccggtttcttaaaaccgcgtgtagactcaacggtcaatgaagtgaacgccggcggtgtagcaaaagaacgcggtatcagcttcagcgagaagatttcctcaaatgaatcaggatatgataactgcatcagcgtaaaagtaaccggagaccggagcacatttacgttaacggctacgtatatccctcacttcggtgaacgaatcgttgaactgaacggctttaatattgacttaaatcctgccggccacctcgtttatatccagcaccaggatacgactggtgtaatcggacgcgtcggacgcatcctcggcgataacgatatcaatatcgctaccatgcaggtaggccgtaaagaaaaaggcggagaagccattatgatgctttcttttgataaacatttagatgataaagtcgtcaatgagctgacttcagttcaggatattgtttccgttaaactgattgaccttccgacccattaaacgtaaaaaaacccaaaacatatgaatgttttgggtttttttacgtttaatgggtcggaagcggattaggcgcggcaggcacagcaattggttttgtcacatcataattaccgattttctttgcgtgtgcatgtgtgaacagcacctcagaataaccgaattccttcgcggttaacaaaagtccttcgatcattaaaatgccttccagcgaatcttcaactttatgtttttcagacaattggattcgcagctgctcgccgtcttccttttccgataccgatgcaatcgcatctgcttctataatgctcgcggtctgtgagcctccgtctgttgtcttcatcccgtcaatagcctgatatactgaataataggtttgttcagacgggatgagatactcttgtcccagactgtcgctgtaagaaaaatacgcccggttcgtctgtttatgtacggacatctcagcggaaatgccgtaagatttataaaaatcctgtccggctccgttttgaacctttttcaatttaatccgctcgtaaggactccatgtcaaagtctctttcagcatctttttcaataagtcagcatcggcagctgattcgatagaaagacgtccgtttacctgcacaagcaaatccttcttatccgccgttacctgcacaccgtccaaaaggttcggcacagaaaggaaagattcgggcacttctaagttttctgcatcagataatgcctctgaaaccgattcgtcaggcttctttttttcaaaactgaccggaatgacggcggatgtatctgaatcggcaaacgccaaagtaatgtaattgtttttgttttcgttagaaacgacaaacgtcttctgatccggcttgacagcagctgactgactggctttttcagcttgaccgctgtcagctgtaagatcaccggcagatttgtttgtcatcaggtgaggagaaataatcagagcgatgcacaatgcgcagatgccggctgcggcggggccgatccagcttcgggccggttttttcctgtacggtttacccgtttcaatattccggtaaatggcctcgggtgaacgatgatctctaaccgccggaagttgtcttaacaactcctctactctttcttcgttccaatatgacttcatcatccattagctcctccctcaaaagctccatctgtttccgaagtattttgagccctctgtgttgggtcgttttgactttgctttccgagaagcggagagcggcggctgtttcctgaatggaatatccctgaataaatctcaagataataacagctctttgatcaatggtgcaatgatcaagcgcggtataaatttcccggacattttcatgctgtacggcgagttcgtccggaagcaaatgctgatctctgacatcttgtgtatcccaatcaaacgtacccataatacgctgtctgatcgtctgctgcttgcggaaccagtcaatcgccacatggcgtgcgatggacaacagccatgttttttcactgcttcttccttcaaatgtatgataggaattcaagacgcggatatacacttcctgcgtcaaatcttcagcctgcgacttatcttttaccatataaaataaaaattgatataaatcttgatggtatgcatcgtataatatctgaaaggtttcttccatgggaaacccctccgttcacttttttgtcgtaaaaatgcgttgaaaagttacattacaactatattacgagaaactggaatttggaagggaatttatattaacatattcttaaatttttaaaggagaaacaaacaaaaaacacccgcagaacatgcgtggtgtttcgtatggaacaagattgttcgtcaatttcagacgtcatcctgcacttttgtcggaatataaaatgtaaacgtcgtccctttgtcgatgctgctgtgaaccgcaattgagccgccgtgggcttccacgatattttttacgatggcgagtccgagtccggtccccgccctgcctcttgttcttgctttgtccgctttataaaaacgttcaaaaataaaaggcagatcctcttccggtattcccgagccggaatctttgatatcgattttcagtccgtcttttacggtctgagccgcgatatgaacgcttccgcctgactccgtatggcgcagcgcattatctataaggttggtaaacacctgttccattttgtcttcgtcaaagacacactccggctgagacaccgagatgtcctctgtgagcgaaacgcctttttccttcgctagcccggaaaatttgcgggagatcttctccagaaattcatacaggtttaccgtttcatagcgcaggcccgtatgtccggattccattctggccaaatccagcaaatcattgacaagccggcccatgcgaagagattcatcataaatgatctgcgcgatttcttttttctcctcttcggtgcttgcaatgtcgtccactattgcttcactgtatccctgcagcatagaaatcggggttctgagctcatgactgacattggcaatgaagtcttcacgcaatttatccagcctgcgctcttcggtcatatcacggagcacggccacggcgccgcggacgtgtgattccgcataaagaggcgacatcaataaaacccatgaccttccttgaagcgtcatttcaatcatttgctctttttccgtgttcactgcattttgaaatagctcttttgcttcagggggaaggttgtctccttctttaatgttcatgttctgctcataataccatgcctgcagaaaacgttcggccggcgggttggtcaccaaaatggtgccgtcgatattaatggtgatgaccccgtctgccatactgcttaaaatattggacagctgttctttttcctgatttagcgcgttaatatggaaattgagctgccgtcccatctgattaaaggcaatggccagttccccgatttcatcttgggtcagaatcggaatttttgtatcaaactttcctttcgccaagtcttgggcgccttcccgcattttccgaagaggatatgtcaccctgctggataaaaagaacgcgaaaaacgttgtcaagacgatggcaatgcccgccgcaagaaaaatatagcgtgtcgtatgtttcgtcgtatctttgacggcaagcagcgattgggataaaaagaccatgccttttttgccgtctttttcatacggcactccgacgatcagccgttcgttatccgaaccggcatttttggggaccgcgcgtttgcttactttattgcggtctgtcagcgccttgtgcagatcccggtcatgtttaatctgctctaatgtaatagaggataaatgattatcgtcattgggcgaataccagacatgcttatcatcctgaatgatcgcgatgctcgttaaattgtccgccagttcccacgtgatggatctggcaagcggctggtcttcatgattttctattatgaccgcaattttatcggcaagctgcgttaaatctttttccgcttcttcaacatggtaattttctataaattccagaagcagcaccgttaaaataaataaaacaattaacacgagtgaaagaatggtaaaccaaagctttcctactacgcttttccaaaacttcattcagcgcctacctcaaatttgtatccgactccccagacggtgacgattttttttgccgctcccgggacactttgtttaatttttcacggagccgtttgacatgagtgtccaccgttctgaggtctccgaaaaattcatactgccacacttcttttaaaagcttttccctgtcgtacactttgtccggtgttttcgccaggaagtacagcagttcatattccttcggcgtcaggctcacctccgtgccgtccgcagtcaccctgtgagcatcgtgatcaatggatagatgcgaaaagacgagcacattttttgtcggggtattggctgtcagataagatgtttgggaagcccttcttaaaagcgcctttacccgaagcaccacttctctcgggctgaaaggcttgacgatataatcgtccgtacctgcttcaaatccctggacgcggttggcttcttccccttttgccgtcagcatgataatcggggtcgcttttttttctctgagctgccggcatacttctattccgtccgttcccggcatcattaaatccaagagcaccagatcataatctgatgccagccccattttaatggcctcgtctccgttttccgcttcttcaatcacatagttttcccgttcaaggtacattcttaaaaggcgtcgaattctggcttcatcatctactactaatattttagtttcatttgtttgatccatcgttttccccctgctttccttctgttactttcattttaacaaactgtgcggcagcttgagaactgtatcggctttttgcatctatgcgtacgaatgaagtccggcaagcacaagattcacaaaaattaagttaaacataataatggcgaagccgatgacggcaagccacgcggacttttcgccatgccagcctcttgacagccgcaagtgcaaatacgctgcgtaaaataaaaaggtgatcagcgcccatacttccttcgggtcccagccccaaaaacgcgtccatgcaagctgcgcccaaatcatcgcaaacacaagcgcgccgagtgtgaataccggaaaaccgatggaaacagcgcggtagccgacttcatcgaccaagtccagattcacatttttgacgagcgggcttataagagcgctgattctctttctgaatatcagcctgagcgccccgtataaaacgagacctgcgccaaacgaccagatcaccgtattgacctttctgcccgaaaaaatggccggaagctcaataagcggcttcattgcgccttccgtaagcagttctccgtcatgcggaccgacaagcgcaggcatatcatatatcatcacgcttttagcctcttttttatccacccaattaaattctgctttgtaatccgccagccggaatgccgacgtgacggcgataaatgccacggtcgtcacgagtataaacatgatgacttcaagccagaacgtttttttgcccggtctggattggtcgacatgctttaacaggaaaatgacgccggctacaaaactgatcgcaagaatcgcctgcccgagcgcagccgtcgtgacgtgaatgtacagccaattgctctgcagtgacggaataagcggcgtgatgtctgtcggaaacatgcttgcatatgcgataagcaaaagcgcgatagacaatgtgaacatgcctaatgaaggcagtctgtaaataaagtaaataataataaaagcgagaacaagcatcatgccgaatgacgtcgtaaattcaaacatattgctgacaggcgcatgtccgcttgccgaccatctcgcaatgaaatagccgagatgacaaagaaatccgaaaatggttaacgtgattccgatagccgaccagcggcccttaccgtccttcgcaccttttgttccccggatggcgccgccgaaaaccgggacggcaattaaataaatcaaaaaggcagcataaagaaaatttgcactcagctccgccatgacaccactcctttttcactaggcctgatttttggccaattctttttgatcggccggctcttgaatcccggtcccgctaagaacaaattcgatatcctttttcagaccgaaccagtttttgttcgtatgtcccgccacaagcacttcatgatcacctgttttgatccagatccttctgtgctgccagtacatcccttgaatgacgccgatcataaagatcgcgccgccgacggcaagcacccataaggttaagtcttttctgacagtgagtcctgtaatgtttttcgtttccacatggtcgaattttaatttgtacttgttactttcggaaccttcaacagtctgctgaatcgcaacaaaacttttctcccctttcggcttgtcgggagccgtgattttaaagacaaaagccggattgttaggaaccttcgttttcgtgctcggttctccgtccttgttaaaataaaaatcaggaagataactggcgatctgcactttgtaaccgttaccaagatcgtagtccgtgtcgggatcaagaagattgatcttcagtttgccgaatgactgttttgttttttggtcgatcagctgaaataccatctgatcgagctggttttctttataatccacctgatacacagaataggagtcaaagcgcagcggttcattgacgcggatattgttttctttgactcttttaagcttcggcttttcaccgaatacaatgtcgccttccctcttgtacaaaaccgcgtccgttgtgaaagatttggcgactttgccgtttccggctctgtcaatggcgtcggcgaatacttttttctcagtgtctttgttatatgtctgcatcgtgaaccggttgttttttaagtaatatttgccgtcagtaccggggatctgggcggtttcgccttcacggacccagagcgtttcatcgacatacataccgggtacaaatctcagcatggctccgatcagaaaaatgatcaggccgatatgattgacatagggtccccaccttgaaaaacggcctttttccgccaggatgcttccctcttgttctcgcactctataatgcttttttttcaatcgtgttctgaggccatcagccgtatccccgctcagctcggtttctgtccggctgtatagacgctgcctcttcaaaaagaccggattccgccgtactccttgatttttcagcgccctgtacaaaggaatcacccgatccaggctgcagatgaccagtgatatgccaatggatgcgatcaggagcatataccaccatgagccgtacaggtgatgaaaccccagcaaataatacagttggccgattatgccgtactgctgttcataatatgtatccggctgggcacccggcggcagataagcttcctgcggaaaaaccgtgccgaaagcagacgccgccagagtaatgacgatcagccatattccgacttttacggaagaaaagaagttccataccttatctacgattgttttgttatatgtttgcgaacgccttgcgctgccgtcgtaccgcatatcggcaagcggtgatttttgttcatcaagcggcttcccgcacgactcgcacaaaaccgtcccggctggattcacgtgcccgcattcacatttgacctttttcatgaagacgcctccggcttaattaaattcatatagtcatgaaccatgcgttctgtcatcgtgccggtcaccactttcacgacttttccgtcgggattgatcaaaaatgtcgtcggaataggtgatacgccgtacgcgtccagcacttgccggtcagtatcgagcgcaaccgggaaattgacgccgtatgttttcataaaattatgtactgcaatttttgattcgccgacatttaccgcaaccacctcgacaccgaggtctttaaaatgcttgtattgattctccatgtagggaaattcctgcttgcacggctcacaccacgttccccagaaattcagaaaaacacctttcccttttaactgactcagttctatgagtctgccctctgtatctttcagcgcgaaattcggggctttggacccctcagatatacgctctccgtttgtgtaaacggcattatagatggtatatccgagcgcgcagagtaagatgagaaggatgccggtccgaatgaataaacgccgccgttttttgttcattgtacactgctcccctcccctgtctgcaaatccattcaattatatcatctacacgttttgtaatttttgaaggttatgtgaaaattagaaagcgtttttaccgtgttcagctaaagcccgcagccttttcacctcatgcggcgtcaattctcttgcgtctcctgtgcgcagacctcttaaatctaaaaatgcgtattcttcacgtttgagtttcagcacgtcatgaccgatcgcctcaaacatgcggcggacctgtctgtttcggccttcatgaatcgtcagctgaataatgctcgtctgctttcttttgtccagggaaagcattttcgctctggccggcgctgtcttgccttcttcaagctgaatgccgcgctcaagctttctcagaagttccttggaaggaatccccttcactttggcgacgtacgtcttatcaatttcgtatttcggatgcatgagtttgttggcaaactcgccgtcatttgtcagcaataaaagtccgctcgtatcataatcaagcctgccgatcggataaatgcgctgcggcacttctttgaaaaagtcggtcaccactttccgccctttgtcgtcatcagctgctgagatcactcctctcggtttataaagcagaaagtacacgggttcttcccgctccacctttaatccgtttacttcaatctgatcagaaccggtcacttttacgccgagctctgttattacttttccattcacctttacttttccttcttttatcagctcttctgcctttctgcgtgatgccacgccggcatgagcaataactttttgcagtctttccatgtcgttcacctcaagtataatcttacttttttccccttgaacaaacaagctttttcaaggagagttattctgatatataaaaagcgcctgatttcaggcgcttccaaataataacgtaactatgatgattgatgcaaccaccccgatcagatcagcaagaagaccaacctttaaagcatcccccatttttttgatgccgaccgccccgaaatacaccgtcaggacatacagcgtcgtgtcagtcgatccctgcatgaccgaggccagtctgccgataaatgaatcaggcccgtacacggcgatcagatctgtcgtcatgccgagcgccgccgtccccgaaatcgggcggatcagagcaagcggcacgacttctgcgggaatgccgagcgctgtaaagaaaggcttgcacagccccatgacaaaatccagcgcgcctgaggcccggaatacggtaatcgccaccagcatcccgaccaaatacggaatgatggaaaacgcaatctcaattccttcttttccgccttcaacgaatgattcatacgtcggcacttttttgatcgtgccgtatatcaatataccggcgataataatcggaatcatggctaaagacagccaattcaccatttccattcgcttacctcccttttcttttgcggcggtaccagaagtagcggtcaatgaaaatcgcgccgattcccgaaattaaagtcgctaagatggtcggcccgacgatatcggtcggtgatttcgccgaataagccatgcgcacggcaatgacggttgtcggtatcaatgtaatactcgaagtatttaccgccaaaaaggtgatcatggaacggctggcctcagacttacctccattcagctttttcatctgctccatggctttaataccgagcggtgtcgccgcatttcccagtccgaaaaagtttgccatgagatttgataagatgtatcccatcgccggatgatcagggggaatatcgggaaacagcttagagataaacgggcggcacattctgctgaatatatccaaaaggccggactgctcggctattttcatcaggccgagccagaagacgaggacgctcattaatccgaacgagatcgtaaccgcttctttcgctcctttaaaaacagcttcattcacatcctgcaaggtaccgttaaacatcgcaaagacaagtccgattaccgtcagacatacccagattaaattgaccatgacgaaccgcccgccgcgctcataaacaggctcgtaaacgtctcaatgaaatgctttttcggttttttatggcgctcgttttcataatagacgggaatcttggcgatcactttcccatcatgcataacagtcatccggccgacgacatcaggaatgagagaggcgtcctttttccaggcttttttcggttttattaaggttgtgcggatttttacatcgtcgatttcatcctcttttaataaatatttgacatcccgggcaataaaagcgtgttttccgtaaaacgtctttttcagcttcgggatgccgccttttttagcgacgacataggttttatagtgctcaaagacataattaaacatattcatatggtcatcccagtcatccggatcatttatggtgaccgcgatgagatccgttccgtcttttgaagccgtcgaaacgagcgtccgtttcgcgatttttgtgtaacccgtttttccgcctgtgctgtaacggtagagcccagtcagaagcttgtttttatttttccatacccggtccatcgtttccgccttatacacttttgtgcctgaaacggtccggtattccttgattttcatcgcgtatttagtcaaaagcgccatgtcatacgccgtagaatataaattttcatggtcgtccagcccgtgcggattttgaaattttgtattttccatcccgatttgctcggcttttttgttcatcataaatacaaaaccgtcaaggcttccgccgacatattccgctattgccgcagcggcgtcatttcctgatctcagcataagcccgtaaacgagatctttcagctttactttttgtcccggctgaagataaatggctgagccttccgtttttacggcattcggggaaaccgtcacggtctcttccatcttccctgattcaatcgccagcaccgccgtcatgattttcgtaatgcttgcaatccgccgcttatgatgttcatccttggcgaataacaccctgccagatgctccgtcgataataatcgcgctttttgcgctgacatgtatttgggcatgtgccgtattgccgtctgtaatggaaaaaagaataacaaaagtcaaaagaaatacggcagcttttttgagaaagcgcatgaatgctcacgtccttgttgtgggtttgtacaagtttatgcgcctgtccatgacttatgaataccaattgcatcactttcacataaaaaaactctcccaaaaggaagagtttttatctgactgatgccatatttgagcctgatgcttcatattgcgccaattcttcccgcatgcgcagaaattcactgctgagcgaaagcagaaggctccgcagcgagtccggcacttgctggtagaattcaatcgcgctttggcctgtataagcggcgcggctgttttcgtaccatgtatcctttttcggcatgaaaaactcttccacgcactgatgatacactttatacagcgttttttccgctctcacctcatgaaacggctcctgcattaagagccgccggcaggcttcctgggcgccttcgcaaaagacggtcatcctcctcagcacactgagcacgtcgcggcagtatgcctcatccgcctctccttgagcccgcatctccggcaatgttgtatgatttaaatagctgctgaccatcgtgacaacctcggctaaaaattcaccagtttcttcagtatgggccctcacaatcgaatttcccatttccgtccgtttccttcctctcttgtacgtcgtcatttgcgtcattcatcaatggcctttccctactatcgtatgatgaaaaacggttattatttaatatcctcaaaagtttggttgaagttttcaaagaataaatcggcttcctcctggagaacgtcctcctccgcattttcaggaagcggcgggagctcctccaatgtttttaagccgaattgttcaagaaataccggtgtcgtgccgtataaaatcgcccggccgggaccgtcggcgcggcccacctcacacagcaacgcttttgacacgaggctgtgcagaatccgctcagacttcacgccccggatatcttcaatttccgcccgtgtgatcggctgcttgtacgaaacgatcgccagcacttccaaagaagcctgtgacagcccttttgacggcacttcgattagttttttcaaataaggcacgaattcttttttcgttccaagcatatacgtatccgcatattcggtaagctcgatgcctctgtcgtcttccttgtactgagcggccacttcttccatgattccggccagttccgcttcttctatttcaagcaccgtcaccaattgctttttggtcagcccttcatcacccgccgcatacagcagggcttccacaatcgctttccaattcacgatatcaagcgccatgaatggattcactccccgtaatgtatatatctgaaaagttttcttcctgttcaatgataatctgctgatttttcatcagttccaggactgctaaaaacgtcacgacgagatggtctttttgccgagaaggaaaaagctccgtgaagtttattcttctccccgccgtttttaagcttttaacgatttcgttcattctgtcttcaatcggtatttcctgtcttgtaatggtcgtttctttcggccgcgtgatttttttacgctgaagcaccttttgaaacgcgccgatcatgtcataaacggtcaccgacagtttctgctcggtctgtttgatttcttttgcatactcacttaaatcactcggcggctttgtaaatgacttttgtctttcttcttcccgctcttttaaatccttcgcagcggttttatactttctatactcaatcagcttttcaatcagctcgtcccgagggtcttcttcttcaagcatttcgtcttcaaacagctcttcctcttgtttcggaagcagcattctgcttttaatgctgagaagcgtcgccgccatgaccagatattcactggcgacatcaagttcaagctcttgcattgtatgtacatataataaatattgttcagtaatggttgccacgggtatgtcgtatatgtcgatttcaagacggttaatcagatgaagcagcaggtccagtgggccttcaaacgtatcaattttcacttgatattctaccattatctcaccattttcagtatcactctcattgccggaaaaactggctaccctttagtataatccaccgaaatgctctcgtccaatacttttatacacgtcctccgttatttagaaaatactgaaaaagaagatatacgcctatacctttaaaggcggatgcacatatgatagccgtgtaaacttgaaacaaagggaggctgatttcacatgagcggagcttgtttcggcggaggttttgcattaattgtcgttctgtttattttgctcgttgtcgtaggagcatcttacatctgctagttcctcaggcttcagacaccaagccgctctttttccttttcatagcgctgtggtacactggttttagcataaaaggaggaagcggcttgtatcctaaagcttatatcggctttttggccgaatttcacgcatcaagagattattttgagtgtcatgaactgttagaggaacattggaaagaaagcccggctgaaaagcggagcattcattgggtcggcctgattcagcttgccgtcgctctgtatcaccagcgcaggggaaatgaagccggggcgaaacggctgattgccaacagcttacgtattctgcggtctgaaaagcaggcggtctgttctctcgggctcagccatccgaagctgattgagctgatagaaacgctgtcagacgatatagaagcgggcctgccttacagaagtgttatgcttccgattacagatgaagccctgaaagaagcatgtcttgccgaatgccgccaaaagggttatacatgggggcaagacggcgtatcagatacctttcttattcataaacaccgcctgcgggacaggacggatgtcattaaggaacgcgaacgggaaatggagagaagaaaaaaaagcagaggctgacggtcagccctgctttttctatatcaaaacagctcccgaaaccgtgaagattccgggagcatttgtcagttattatatgagatatcctgatctttttgatgttgacagcgttcaaaaaagctttgcgttaattcattcggaacgagtgcctccgttttgaacagacgttttaaggcgtccatcatttgctttccgattccttgatggcggtgagaaggattcacgctgatatgccggatttcaacctctgagtcctttttttcgactccgatcgctccgacgatatcttcatcctctttccaaagaaagagctggcggccagtatccgtttcatagtcctttattgtctgctgaagctgcttgagatctttttcattcggcataaatgacagaagacccatcgcaatcttttcaaacgattttttataacgaattaacataaaaacccctctatatccaaaatgtccattcatgtcctatcaaacggatacataaaggcgatccgttttctcacattatatcattttcgccgcggttttaaacgcttttcaacaaattattcaaatgagcggtttaaatttgccatttcaatggcagatactgcgcaatctgctcccttatttccagcttttgttccggctcgttcgatggcctgctcaatggtttcagtcgtcacgatgccgaagataaccgggacgcccgtcgccgttcccgcctgggcgatgccttttgccgcttcattgcagacatagtcataatgcgttgtcgctcctctgataaccgtgccgagcgtaatgacggcatcgtattttttcgtttccgccattttctttgccgcaaacgggatttcaaacgctcccggcacccaagcgacgtcaatgtcgtttgattctacaccgtggcgaagcagcgtgtcttccgctccgcttaacagcttgctcgttataaattcattaaatctgccgacgacgattccgattttaagtcctgttcctactaggtttccttgtatgatattcatatgttatccatccttttttgtgagatttgtttttagaaatgaagcagatgtccaagttttttcattttggtctgtaaatactgtttgttatgcttactcgcttccatttgaagcggcacccgttctgaaatgctgagaccgtatccttcgaggccggcgattttccgggggttattggttaaaagtttcatatgctgaacccctaagtcgcggagaatctgggcgccgatgccgtagttgcgcagatcaggcagaaagccgagcgcttcgttcgcttcaaccgtgtcgtacccttgttcctgcaatcggtacgccttcagcttattgattaaaccgattcctctgccttcctggcgcaaatacaatagaacgccgcggccttcttcagcaatttgcgcaagcgcggcatgaagctgaggtccgcaatcacagcgatgggatgcaaacacatcgcccgtcaggcattctgagtgcactctgacaagaacgggttcgctgttaaacgggacatcccccatgacaaaggcgagatgttcttttccgtcaacctcgtttgtatatccgtaaactctaaacgtgccgaagtcagtcggcagcgtaatatcaacttctctgttcacaagtgtcgtaatgttgtaacggtactctattaagtcttttatcgtaatcattttcagctggtggcgttcggcgatttcggctaactccggcactctggccattgtgccgtcttcattcataatttcacaaatgacgcccgctccctgagaaccgcaggcttttgcaaggtcaacggctgcttccgtatggcccgcccgcttcaggacgcctcctttttttgcgattaaggggaaaatgtggcccggacgctgaaaatcgtcagacacagattcctcgttcaacagcgcctgaatcgtaaaagaacgttcttgagcgctgatgcctgtttttgtcagcctgtggtcaatactgaccgtaaacgcggtctcatgtgagtccgtattatgatcgaccatcgggtgaagatccagccggccggcgatgtcttcagacagcggcgtgcagatcagacctctcccatgggtcgccataaaattcaccacttcaggcgtggcatgctcagccagcgctacgaaatctccttcgttttctctgtcttcatcatcgacaacaatgatgacttcaccttttttcagcgcctctaacgcctcttctatcggatgaaacatatcgatcttcctttctaaaagccgttctcgcttaaaaaggcttccgtgatagtttgattgcttttcttttgttctgttttgtgcaaaaagcggtataagtatttgccgatcatgtcacactcaatatttacggtcgatccgactgttttcgtgtgaaaaatcgtttctgagatggtatgcggaatgatggataccgtcacgctttcgtctgatagaccgaaaatcgtcaggctcacgccgtctaccgtaattgaacctttcaatacgagcgtttttgtcaattccggcgaaagttttaaatcgtaatagaccgcgttgctttttttctcgatccgcgtaatttccgccgttccgtccacatgccctgatacaaagtggccgccgaaccgtccgttggcggacatcgctctttccaggtttactttactgccttttgacaagccgttcagcgaagtggctttcactgtttccggcataacatcaaccgtaaattgattgtcagaaaatccggttacggtcaggcagatgccgtttaccgcaatgctgtcgccaagtttcacatcacttgtcacttttgaagcggtgatggttaatgccatggaaaggcctgtctttttgattgcttggatcgtgcctgtttcttcaacgattcctgtaaacatcgtcaccatcctttccatctttaggtatggccgtcagttttatatccggcccgatttgggtgatttgtgtgaattgcaaatgggggacatctttcattgattgaaaaccttcaccggagatcaagctgggagcaagcgttcctccgattaatttaggggcgaaatagaaatgaagctcttggaaacagccttccttgacaaaacttccgtgtacggatgctccgccttccacataaacggacattattccgttttcagcgagaatactgagcacctcggggatgtgaatgcggtctgtttccagcggaaaaacttttattccgagtgcggtcagccggtctttcttttgcacgtctgcacctttggccgtaaatatccatgtcggcgcagcgccgtcagtgagcacatttgccgtttcaggaatggtcagctttgtatcgagaatcactctgaccggctgcttcaccgcatcaggaagcctgcaggtcaggctcggattatcggctttgactgtgcctgctccgacaagaatgctttggtgcgatttcctgtattgctgggcatcaagccttgccgcctctgatgtaatccatttgctttcaccggtttcggtcgctgttttcccgtcaaggctcgcggccgctttcaaggtgacatacggaagtccggtccgcatgaagtgaagaaacattttattcagctcttctgcctgctgcctgagaagtccggttttcacttcgatgcccgctgcttccagcattccgatgccttttccggctacaagcggattcggatctttcacagcaatgaacaccctttttatccccgactttattatcagttcggcgcatggcggtgtttttccgtaatggctgcaaggctccagcgtcacatacaaatcggcgccttttgcgtgtctgccggccatattaatcgcgtgaacctcggcatgcgcttctccgtattgcaaatgggcgcccattccgacgatctgtccgtttttgacgacgacagcgcctacaagaggattggactgtgtctgtccttcaccgcgtctggcaagttctattgccgtattcatataatattcatccatcgttatccctcccttcttccacgcaatttggcgtcaaaaaagccccgaatgtttacacagttcggggctttgccagttttaatccataggaaataagactatacagcaagtttattttttgcatagcttctctcatccttctcccatccagactttcactgtcggcttcagcttttcactgaatccaccgtatacagatgcatacgggtcacgggctgtaaagcgcaaagcgccttattaccgccggtcgggattttcacccagccccgaaggatacaatcaatatttttttgtccttatccgctattataacatcctttgcggcaggcgcaatgaatttgcacctcattattcagaaaaataaaaagcgcccttttcccataaaaggcgtctttatttattcgttcactttgacgaccttcaataagccgtcaatccggtttgatttgctgaaatacgctttaatcttatcaccttttttcacatcggagagatcctgcttcagcttgtcgccgttaaaaataatttttgtgccgttcgctgccgtaccgtgatactcagttccttcgattttcgtaattttatatgttttgactgtatattcttctttttcctgggacagggtttgtccgattgcagtcggcacgtctttcagttcaatatcgtttatgaccatataaccgcccgctaataacagcagcagtacaagtaaaatggctgcttttgttttaattcttcccatttttctacctccagcccgtatcaatctattcattactatgtcatattcctttttttcatgaatagaaaaccgttcttccctgcgtgagttattcatataacgtttcataaagggaagatgtttcatgtatctgtaaaactttctatctattaaatagatatacgaatttatgttctgtttttgagggtggagagataaatttatataaaaaaagcagttttctcatgaagaaaactgcctgtacggtttatttcgtcttgcgaatttcgttaaacgggaagaagacgaattttgatgtgcccgctatttgttttttcgtaaaaagaccgaggccgttgcggctgtccatagattctctgcggttatcacccatgacgaaatatttgtcgtccggcactttcaccgggccgaagtcttctgtcagccggtcatagccgtcttgcttcgccttgttcttgtttgccgctaaatacggttcggacacttttttgccgttgatatacagctgatcgtttttcatttgcaccgtgtcgccgggaagtccgataatccgtttgacatagtgctcattttctccgttcagcacgacgatctggccgcgtttgaagtcgcttatgtatttgaccgtcatattcacaaagattctctcgcggtcatgcagcgtcggatccattgatcttccatcaacgagataaggggcaaataaaaagtttcggatgagcagtgccagaacgacagcgatgataatggctttcgcccaatcaagtacggtgctttttttagaagttttttctttttctgatttcaagtgatttcctcccattagccatggtcgtttttattttaccatgaatccctgcacagagggcaaataagccccgcaccccatccatttttttcattttataagccggatctgctgattttacggtatttcacgaagcttccgatccgccaaatgcacaaatacacaaaagcaagctccattgttaaaacggcgaattccgccgcgtcaatgtttttgaaatattggctgagcgcgatacggatcgcaataatcgcgataatgacatatttaaagtttttattccgcttggagtagacaaagccgtcttcccggatttcataggcggtttgcgacagcatgatgacaccgaataccgcgcctaacagtccggcgatggcgagctcccaaagagcgggaaaatgaaacggctttcccgggatattcatgagctggctgatactgaatgtgaaaatgacggcgataatcaaaagcgggagaatgatgccgaagccgccgcctttaatcggcctgtttccctttttcaccctgaaccaaatcataagtgcgagaatgataatgacaaataaaacggttgccaattgaaccaacgtttctacctcttttcattgttgtaatcggtctttttcactataccagaatgatcaccgatgttcatatatgtattttttcatgatttacacatgagaattttcatatacataaaaaaacccgcctgaaaaaggcgggttttccgtcattatccttctacacggatttctttcattttgtctccgttagacatgtttttcgcatgctctaaaccgcttgtcacttttccgaatacagtatgaacgccgtttaaatgcggctgcggttcgtgtacgatgaagaattggcttgaacccgtgtctttaccggcatgcgccattgataaagaaccggcttcgtgtttatgcggattgccttctgtttcacatttgatcgtttttccgcttccgcccatgcctgtcccagtcggatctccgccttggctgacaaagcccggaatcacgcggtggaaaataacgccgtcataaaagcccgtattcgccagattttcaaagttagcgactgtattaggcgcttcattcggataaagttcaaattcgattctgctgccgttttccatttcgatgtaaccagttttcattctcattcctacttccgtattgttttttgtcaaagccttcttcaatatgaatttcaattgtaagccggctttctttttgatattcttttgaaggaagaggcctctgctcttcttttcgcggctattataccacaccttcagccggaaaacgaatctccccgcttccgcagaaagaaaatgaaaccagaacagcttcacagccgtctatgtatcggaactgcttcacgcaggtcctcacaaaccgcttcaaaacggcatttgtgaaaagaaggaggttaaccgctttgaaaaaaatgtggattggattgctggcggcggccgttgtattgtgcacaataccgaaaatcagcctggccgatgccgcagtcggagatgtcatcgtcacactgggggcggatctgtcgaacgaaaaccgtcagaaagtgcttgacgaattaaatgtccctgataacgcgacaaaagtgacggtcacaaataaagaagaacatgaatatctgggaaaatatatatcgaacgcccaaatcggcacaagagccatctcttcgtcatccatcacggtggctaagaaagggtccgggcttgacgttaagacccataatatcgattccattacggatgaaatgtacttaaacgccctgatgacagcaggagtgaaagatgcgaaagtatacgtgacggcgccgtttgaggtatcaggcaccgcagcattaacgggaatcatcaaggcatatgaagtctcatcagacaaagcaatttcagaagatgtaaaacaggtcgccaaccaagagcttgtcaccacttcaaatctcggggataaaatcggggataaaaacgcctccgcacttatcgcaaacattaaagatgatttcgcgaaaaacggtgtgcccgatacaaaagaaggaatcgagaaaaaggtcgatgatgcggcttcaaaccttaatattacactgactgacgctcaaaaagaccagcttgtttcattgtttaataaaatgaaaaatgcaaagattgattggggccaagtcggcagccagctcgataaggcaaaagacaaaatcacgaagttcattcaatccgatgaaggcaaaagctttattcaaaaagttattgatttcttcgcttcgatttggaatgcgatcgtgtctgtatttacaggagacagcggatcaagttctgacagctgaacgcaaaaagagaccggacgccattgttccggtctctttttcatttattgtttgacccccgtcttaaacggcagatccagttttacaatgtcttcataagtttctcttctaatgacaagatgcgcttcgccgtcttccacaaaaacgacggcgggacgcggaatgcggttgtagttgttagccatgctgtacccgtatgctcccgtgcagaaaacggcgagaagatcgccttctttcacttccggaaggtctatatcccaaatgagcatatccccgctttcacagcacttacccgcgatggataccgttttgtcgtggtgttctccgattctgtttgccgatacggcttcatatttcgcctgatacagcgcaggacggatattatcgctcatgcccccgtcaaccgctgcatatttacgggtgccgggcacttctttttgcgaaccgatggtataaagcgtcgttccggcgtctccgacgagcgagcgtcccggttcaatccagatctccggaatgtcaaaagcgtgcagctctgcgttttcttttaccgcttcgataattttttccacataaacggcgggatgaaggggttcatcctcttccgtgtagcggatgccgaagccgccccctaaattcagcacttcagagacaaagccgaatgattctctccattcattcagttttgcgaagattttttctgcggccagcacaaagcccgccgtatcaaaaatttgcgatccgatgtggcagtgaacgccgagaagccggatatggtctgactgcaatacttgttcaatcgccttttctatttgcccgttatgcagatcaaaaccgaatttggaatcttcctgtcccgtcgtaatataatcatgcgtatgcgcctctacccccggagtgatccgcagaagcacatccattgtgcgccctgatttgcggcacagttccgcgagtaaggatatttcataaaaattatcaacgacgatgcagccgatttgatgatcgagcgccattttcaactcttctttgcttttgttgttgccgtgaaaatgaatcctgtcagccggaaaaccagccgcaaccgccgtaaacagctctccgccggatacaacgtccaatgagagcccctcctgctcagcaagctgtatcatcgcaacggaagaaaacgccttgctcgcgtacgcgacctgcgcctttaaatccgcgtcaatgaatgcctgtttaaagcttttagcgcgctcacgtattaaagccacatcgtaaacataaagaggcgtgccgtaatgctccgctaaatacagcgcgtccacacctccgatttccaaatgacctagtttgttttgtctgcttgtgccatgtaagaacaatgctcattccctctttctgatccgcctatgggtgaaaaggacagcttcttttgagctgtccttatacaagtcccgtataagttaagacatacaatatcataatcttctgtcggtttcaatgcgattatgaaccgcttggctgtctttgacggtctttcgggtgaacaatgctcggtctgactttcgctcccggcactgtcgtccggacgagcacctgccacagcgccttgccgttaaacggtaaaaacggccataaatacggcgtatgaaacgagcggatattcgccattatgatcagcagcaatgtaaagcctatcacaaagcctttcacttggaaaatggccacgagcaccattaagatgaggcgtatcattttattggcgaggctgagctcatagctcggcgtggtaaatgatccgatggcggcgatcgatacgtacagaatcacttctgctgaaaacagccccaccgctatggcgatttgaccgatcagcaccgccgcaatcagacccatggcggtggataaagcggtcggcgtatggatcgcggccatcctgagaaactcaatccccaaatcggccaaaaagatttgcagaatgatcgggatatgcgtatttttatttaaaccgataaaatccaatctttcaggcagaagagacggttcaagaacaaagaggaaccagatcggaagcagaaccgttgaagcgataataccgaaaaacctgatccatcttaaaaatgttcccactgaaggcgcctgcctgtattcttccgcatgctgaacatggtgaaaaatcgttgtcggcgttatgatcacgctcggtgacgtatcaacgacaatgatgacgtgcccttccaaaatgtgattggcggccacatccggccgctccgtgtatctgaccatcggaaacgggttgtagccctgtttgacgataaattcttccaccgttttatcagacatcgtcaatccgtcaatgtcaatcgcattcacttcgttttcgacgatgctgacaaggtccgggtccgcgatgtcttctatatacacaatggcaagatcggtcttagagcgctcgccgactttcgtaattttgacgcggagcctttcgtccctgattcttcttctgatcaatgctgtattaatgacaatattttcgataaaaccgtctcttgccccgcggacgaccttttccgtatccggttcttcaggtgtgcgtccggggtaacttctgacgtcaacgataaaggcgaagcccgcgtcttcaacgataacggccacaagtccggaaagcacttgatctgttgcttcgtcgagcgttttgactttttggacctgctgattgacaagcctgttttcaacaacgtcaatcgcttcatccgcattctcgtcataattattaacgtcgacgagctgttccattaaatgaatgataaacaaagtatcggttaatccgttgacaaagtaaatctggacttcccggtctaatactcgaactttgcggacgccgacatcatagctcgttcccataccgacgcggtctttaaaaaattgttcattttttctaggatcccggtataccttgatcatattttccggtttttccggcatggctttcgctcctttctaaaatgaattcgaccgccttcatcgtaatcggcgagcctttggatatgtcatcttttctccccatctttcctatgtcgccgatgcccacaatgaggggaacgtccaatttatccagacaatacaccgtatctccgttcattctgtgctcgtccatttctctcattccggttttatcgacgccgtactccgtcacttctccatcacggtcaatggagacatcgactttcgtccattcagcctgatgggtcttagaagcgaccgcaatcacccccagcacttcaatgtcctgatgtgaggcgacatatttcagcgccgtttcgcccggcccttccccttgcaggcctgaatcgtcaaacatgacaaacaccgggtcattcggcgcggctttaatcagctgaacaagttcggggccgcttctggttgacggattgccctttgattgggaaatacaccgtccgcctgctttttccgcggcatattcaattgttttggcggcgtatacgtccccgtctgtcacaagaatgaccttccgtttcgtcatcaggcattatcctttcggtttaaaaataatggctacaagaaatgcgaataaaatcgctgaagatataccggcggaagtaagttcaaaaatccccatggcgatcccgataaatccatgctcgtgagcttgatgcatggcgccgtgcaataagctgtgaccgaagctgacgatgggaaccgtcgcgcccgcacctgcaaattcgataaatttgtcatatattccgaacccatccaacaaggcgccgatgacgacaaaagttgtcatcacatgggcgggtgtcagtttaaaaatgtcaagcagcagctgaccgataatgcatatgattcccccgcaaacaaaagccaacagatattccatttatgatgcacctcccgcccgctcaaataccacaccgtgcgcgatggtcggaatggtttctttctgctggatcattgtcggacttaaaagcgctcctgtcgcgacaacgagcaccctgttcagagcccctgattttaattgattaaaaatatgtgtgtacgtaacaagcgcggagcaggcgcagccgcttccgcccgcaaacacctgctggtccggcgtatagatgagaagaccgcagtcatcgtgtttcgttccgacgggatagccttcttctttgagcaaatctttcacgatcggcgagccgacgcctgaaaggtctcccgttaaaatcagatcataatcatccgccgtgcggtttaagtcctgcaggtgctgtttgattgtgtcggcggcagctggcgccatggcggatcccatatcgaacggatctgttattccgaggtcgcttacttttcccactgttgcgcttgtaatcttgatatcagaagggttttggctgatgatgaccgccccgccccccgtgaccgtcgaagtggcggtatccggtttttgcccgccatattccgtcggattgcgaaattgccgttctgcggtcgcgttatggctgctcgtggctgcgatcgcccggttcgcaaaaccgccgtcaatgagcgcggatgcgacggcaatcgtttccattgatgtcgaacaggcgccgaacagacagaggaacgggattttcagatgtctggcgacgtagttggcggtcacattttgatttaaaagatcccccgcgagtaacaaatcaatatcgctctttttcaaattctgtttttgcaaagctgagttgatggcatcttccattaactgacgttccgccatttcccagtttttctgattgcaatgcatttcatcgtatgtcttatcaaacagcgaaccgagcgggccgtctttttctttcggtccggctgccgtccccgccgcatttacaaataacgggttttcaaacacccaggtttgctttccggttaatttcattttttctcctcctacgaaaacagtttttcacaagcaaaccgtatcaggcctacgatataggctgccacgacgccgaatacaatgacgtttcccgccaatttaaacatgtttgtcgctactccgagcacgagtccttcacttctgtgttccagagccgcgcttgtcatactgtttgcaaaacccgtcaccggcacggctgaacccgctccggcaaactgcccgagtctgtcataaatgccgaatccggtcaaaagagcggaaattaaaataagagtggcggccgtcgggttgcccgctgttttttcattaaaattaaaaaagtggatgtaaaagtcttgaagagcctgcccgatcagacagatcaaaccgccgatcagaaaggctttgacgcaattccaaacatatggcggtttcggctgatagtctttcacttttgttttgtaattttcttttaagtttgtcacgtcggttcctccttatgaatgatggataaaatacagccaatgaaataaagagccggctattttgccgaacacaatggccatcagcaatatgatgattttgctgccgaagccgatccgtttggcaagaatgggaagcacattcagcacttctgtaagcgctgcggccagcatgccgataaacatgccggccaaaagcccgaccggaacggccagccattcagataaaaaaaaatgatttatatttaaggtttcccagccgccgaacacagctcctgaaataacagctccttcgtaggcctgtacaaagcgcattgtttttgtcagctgcataaggcgggggacgattcccataacggttaaaaaagccacaaagcccgcgcccacggtcagccctccgccaagcccgacaaatataacgaaaagaatgctaacgatcatgcagatctttcatcgtctcttcattttcgtgcattgcgacataatgatcgagatcaatctgataattaaacatctcgacttccagcgggcttggctcttcattcaggcgttttttgaagatgtgattaaaaaagacgatcataccgagaccgaggccgatgctgtatggaatctgaagcagatacgggtattcattccgttcgcccgttatgatttcatataaggcgatatgaacttctctcatactgacatcttcatgaaaattcataatggcaagacatgaaccgataaaaagcaggagccagacaccgacgaataaaacggctgacagctgctttttctggtaatggatttccactatcgtttcagcgccgccgacggtctgtacatcaagcgcgggaaaagcggtatgaatggttttcagcacttttatgatgtccagcacgacgatatttttgtcttttttcgtgaccttatacagcggcagtgccgacagtttttttttcagcttttgctgtcccgcaatctgcgcggcgtcgccgactgtgatgatatctccggtatgagccttcacgcggtggcgaagtctgagaaatattcgtctttccatcttgcatcaccatctttcgggtggttatatatgtagtatgtggttcacttttgttctcattcatcagcggcaaaagaccataaattaccaccggtgcacaaataaaaaaagccggcccgtaaaaggtcagctttccgtatgatccatctgcactttaatctgctttaatatttttttctccagcctcgatacctgaacttgggaaatcccgagccgttcggctacttccgactgtgtctgatctttataatatctcagatagacaatgagtttttcccgttcttccaaatcactgatcgcttccttgagggcgattttgtcaaaccacttctcttctgaatgatcagcgatctgatcaagcagggtgatcgggtctccgtcattttcatacacggtctcatgaatggatgaaggcgcccgcaccgcttcctgcgcaagcaccacatcctccgcatcaatttctaaatgatccgcaatttcctgaacggtcggcactcttccgtatgtttttgacagttcatctttcgcccggcgtattttattgccgagctcttttaaagatcttgatactttgacggttccgtcatcgcggatgaagcgctggatttctccgataatcatcggcacggcataagttgaaaaacggacatcataggacaaatcgaatttatcaacggattttaataatccgatacagccgatctgaaacagatcgtccggctcatagcctctgtttaaaaacctttgaacgacggaccacacaagacgcatgtttttttctatgaggaggtctcttgcctgctggtcgccctcttggctctttttgattaattctttgacttcatggtccttgagctgcgcgtttttgctgtttttcttaacctccacatccataacaaatctccttaattacaaagcgctttgctttttgataggtgttttgttaagcgtatcgtcgttcccatctccggcgaagaatcaatcgtgacatcatccatgaagttttccataatggtaaagcccataccggagcgctcaagctcgggttttgtcgtaaagagcggctggcgcgcttcctcaagatccgtgatcccgaggccttcgtcacgtatggtcagatagacgacatgatcctccagcgtaacggagatgtacacctttccgtcgcagttttcttcatagccgtggatgattgcgtttgttaccgcttctgatacgacggtcttgatttccgtaagctcatccatcgtcgggtcgagctgcgcgataaaagaagcaactgttacgcgcgcaaacgattcgttctgactgagggctgaaaattcaagatgcatctcgtttttcatgatgccacccccaacgttaaaagcgctttttgttccgattgttcgaacctgatgattttaaacaggccggacatgtcaaacaggcgtctcaccgcgggcgaaatcgcgcacacgaccatttctccgccgagctgtttaatttgtttataacgccctaaaatcacgccgaggccggagctgtccatgaaggtaagatcttcaaggttcagcacaatgtgacggatgccgtcagcctccagcgattcagtaaccctttgttttaatgattctgccgtatgatggtcgagttcacctgttaatcgaatacaaagcacggattctttgacatgaaagtcaattccaaggctcatgctcattcctccttgatatgatcggataatgagtgtttcgatttttgggaaagcaattccttcactatgacaaaactagtgcccgttcgccacgattatttaaattttgtccaatctcccatcgtccgcttcagaaaagtgagaaaacccgctttttccatgtcgtcttttgccgtgaccgggctttcaacgagcacctttccatcttttttcagaacgaggctgccgagcacctctccttttttaaccggagccgttacattgccgttgattttcacttctttttttactttgtccatgttctctccctttttggccagaagagagatcggctcagatgtggtcagcttgatcagtttctgttttccttttttcacttttaccgttccgacgatttgattccgtttgtacagcgggtgtgttttgaactggctgaaggcgtaatcaagcattttggtcacttgggcgtttctttctttcggggtgctggctccgaaaacgacagcgatgaccctcatatttccttttttagcggtggcggttaaacaatacttcgcttcgcctgtaaagcccgtcttcacgccgtctacacccggataaaatttgatcagccggtttgtattgacgagccagaactttttgtctgtattttctcttaaataatcctcatacgttcccgtaaattgagtgattttatcgtactttaataattccttcgccattttcgccatgtcataagcagagctgtaatggtctttttcaggcagtcccgtcgggtttttgaaggaggtatctttcaatcccaattcttttgcttttttgttcatccggctgacgaaatcctcttctgaaccggcgatatactccgccattgcgacagatgcgtcatttccggaagctatcgcaattcctttgagcatttcttttaccgtcatttcttctccgggttcaaggaaaatctgtgatccgcccatagacgcggcgtgttcactcgtcttgactttatcgctcatctttattttccctttgtcaagcgcttccatgattaaaagcatggtcatgatttttgtcatgcttgccggcgccagacgctcccggctgttcttgttataaagaatgcttcccgtatcgcgttcaatcagcacggcgcttttggcttcatgagcgagctccgatgtatgttttccgtccggctttgcaaaagcggacggtgctgatgccgttaataaaatgccaatcaacaaagtggatataagacgtttcatctccaaagccctccatttcataatcctttttattttttccaaatccggtggttttatacgcctcatctggaaaatgtttcgtgttgagggcacaaaaaaacagctgcttccgaagaaacagctgacttatgctgacttatttttgagatcgtgcgactacggctttgacaagcttcaaaaagccgccttttactttttccgtcatttccattacttcttcatgggataacggctggtcaagaatacccgccgccgcgttggaaatgcatgagatgccgagcacgcgcatccccgcgtggttggcgacgatgacttccggcacggtcgacatgccgacagcgtcagaccccatcgttcttaaaaaccgaacctcagcaggcgtttcgtaagacggccccgtaacagctgtatacacacctttttgaacaggaatgcccagctcatcggccgttttttcagccaagcttgacagctctttgtcataggcttctgacatgtccgggaatctcgctccgaattcagcttcgttcggcccgattaacgggttggtgcctgtaaagttgatatggtctgtaataatcatcagatcgccggcgcggaattcagtgttgataccgccggctgcattcgtcacgacgagagattcaacgccgagcgctttcatcacgcggactgggaatgtgacctgatccattgagtagccttcatagtaatgaaagcggccctgcatcgcgatgacctgcacgccttcaagcgttcccatcacaagctggccggcatggccttctaccgttgagaccggaaaatcagggatcgtttcatatgtaagcttgacagctccctcaatttcatcggccaatacgccgagccctgatcctaaaatcagaccgatctttggtgtttctttcacgtgttctttaataaatgcagcagcacgttcgatcttttgtttcaaaaaaaagtccccctactgtaatcttgataaaaagctttttccatattccggcttttccgttttgaaattatccgcaatggttgcgccgatatcggcaaatgtatccgcaagcggcagctgttcagtgtgtttgtgctttttgctgtaaacaagaagcggcacatactcccgcgtgtgatccgtgccgtgatggacaggatcattgccgtgatccgcagtgatgatcagcagatcgtcttctttcattttttcaaacacttccggaagcctcgcgtcgaattcctcgagcgcttttccgtacccttccggatcgcggcggtgtccgtacagcgcgtcaaaatcaacgaggttggcaaagctcaggcccgtaaactcttcaccgagcgtttcaatcactttgtccatgccatccatattagataccgtgcggcgggaagatgtaatgccttctccgtcataaatatcagaaattttgccgatggaaatgacgtctaatccgctgtctttcattccgttcattaccgtgcggccgaacggtttgagcgcataatcatgacggttcggcgtgcgtttgaagctgcccggttctccgacgaacggtcttgcgataatccggccgaccatgtacttcggatcaagcgtcagttctctggccgtttcacagatgctgtacagctcttccagcggaacgacatcttcgtgagccgcaatctgcagcacggaatctgctgatgtataaacgatcagcgcacccgtttccatatgttcttttccgagctcgtccagaatcgccgtgcctgaagccggcttatttccgatgattttccgtcctgaacgccgctcaagttcctgaagaagttcatccggaaatccttccgggaacactttaaacggtttttcaatgtagaggcccataatctcccagtgccccgtcatcgtatctttcccgtttgacgcctcctgcatttttccgtagtacgcaagagggtgctccgttttttccacgcccttaatgtctccgatcagtccgagaccgagctgcgccatatggggcatatgtaagccgttcatgtgctctgcgatgtgtccgagcgtatttgcgcctatatcattaaaatcggcagcgtccggcgcttcaccgattccgacagaatccattacgatcaaaaatacccggttatatttgtattcagacatcataaaagcctccttttcttccatctgtccattgtagcttacagaggtcagacaactcaagtataaaccgtttacattcttgttgacaatgccgattcaaataattagaaccttctctgtattccgccaatccggcaaaaaaagccgcggcccctccggcagcggctcctaagcgcgcggatgatactgtttgtacacgtccttcagccttgttttcgtcacatgcgtataaatttgcgtcgtggaaatatcggcatgtccgagcatctcctgcacggcgcgcagatccgcgccgttttcaagcaggtgcgttgcaaaagagtgccggagcgtatgcggtgtcagctcttttttaatccccgcttcaagggcgatttttttcaggtttttccagaacccctgacggctgatctgcctgccgtgatgattcagaaaaagcgcttcggttacgtttttctttaataatttccctctggctttttcaatgtatgcttctatcgcatgggaagcggcttcaccaatcggcacaatccgctctttccgcccttttccgaagcagcggacgaatcccatcgtcaaatggacgtcggataatttcagctcgatcatctcgctgacccggatgccggttgcgtacagcagttcaagcatggctttatccctgagaccgaacgggctgtcaagcttaggcgtgtccaataaccgctcaacttcgtgaagcgccaatactttcggaagcgtccgctctgttttttgtgtttcaatatgtaccgaaggatctttatccgcggctttttcccttaacagaaattgatgaaaagaccggatcgacgccaaatgcctggcagacgtcttgccggatttcccggagtcctttatatgctttaaatattgaataatatgaagacgggtcacatcattccatgaagtgatctgaagggtttcagttaagaagagagaataacttttcagatcacgctcataggacatcatcgtattttgggacagccctctttcaaccctcacataatggatgaaatccttaatttgatccttcactcttgatctactccccgttttggtaaaaaaagatcaatcggccgaaccagccgtctttctcctcatgttccgttttggccactttgacggcggagccttccggtttatcgtaccgatgatagttttcatactctgaattcacccatatcatagcataatagaacagcgcggtaaaacctgtgaacagaataaacactttgatcgtatccgcggctgttttcaggaatctgcccatctttcgatcgaccctttctttggcggctgttagtacaccttatgccaatttcaaaggcttttatacataaaaacagcaaaaaaccctttcctggcagaaaaggttcataggcttttactctgtttcatccccgcggcagcggtggcagattccgtgaaaagtcaatctatgatctttaattttaaatttccaatcacgttcaatcacttcttcaacgtcttcaagcagatcttcttcaatttcatcgacggctccgcactccatgcacaccaaatggtgatgaaagtgagccgcgccttctttgcgaaggtcgtagcgggatacgccgtccccgaagttaattttatcaacgacttttaattctgttaataattctaatgtacgatatactgtagcgagaccaatttcaggagatttctcttttacgaggaggtatacatcttctgcgcttaaatggtcttcttcgttttcaagcagcactcttaccgttgcttcccgctgtggcgtaagcttgtagcttgacgagtgcagctgctttttaattcgatcaatacggttttccatgtctttccctcctacgccgcattccatgactcattataacaaaatacgcgcagagttccaactataattattataaactgataaataaaagtattattttgtgataattattctaaaatatgcgtgaagacagcttttccataaacatcggagacacgtacgcttcgagcagtgaagcgatgaccgagaagaaaacgatgagaatcagtacgaaggcgtagcgtccgaaccattggatcggcgcgtcatgaaggctgcgtttgacaaacagctgccggatcagcttcagtgaaaaagcgatggagcatgtccccatgataagatatgccggaatgagaacgatgttttgcggcagaaccgaaataaatgacaggaaaaacccgttcatccccatttgattcactaaaaaaccgaccgtgaagccgacgacgattccttttaaaaacaccataatgaaaataaccggaagaccgatcacggaaataccgagaatccacatcagccccaaatattttacatcatgaaagacggcctgccaaaacatttctgaagcgccggcatgttttccgtcagacagctgtccgaaaaacttgcttaaatagtaatacaaatcttctttctgcgtgatggtcatgctgttgacgatgatcgccccgaaaatgacccccatcaaaaacaagacgaacacaaatatataaagtgacagatgatcctttacatggcgaaaaaacagttctttgtacgattgttttctcataccgctttcctcccgctaatctattgacttgatttagtagattgtatgaaagaaaagagaaaacatgacagagaaatcatagaaaggcgcgagattcgggcataaaaaaagaacccccgtcatcactccggtgatcataggggttcctttttttatgctttattctttcaagcctgtcttttttggttttcgtcactctttcatgggtgctgaaagacggcgccgtcccccttgacaagactgcgtcacgcatcccgtttcttctgagatgctcccgcatttttttcgttttgctcttcgccacgtgccaatcgctcctttttttgcctctttttatcataacaaaaaaatcccgatgtcttcaagaatacggctcatgtttcgaccggtaagcgcgcagagacgttttggcagatgaatagctccccatagcggcgtatccgtaaaaaaaccccatgaaaatccccgcatacacgtgttcatggtgaccgaaaacgatagacacaacatttccggcagcaagggcaatcgtgggaacgaatatgcccggaacccggcagaacactttgatcagctgtgtaacgcataagacgaccggcacgccgatcacagcatcccaaatatttgtatggatcagcggaaaataatccacattgacacctctttattccgtcttttgctatctgttagcctgcctaagaattccgcttcctattcatgataaaaaaacagcaccggcacatgtccggtactgtaagagttgtttattttcctgccgcggcccgttctacggctgctgatacggcctgatgcacgtccgcatccaaaggctgaggcacgagatcgccgtgttttgtgcaagaggcgatggcttctgcggccgccacaagcatttcatggtcgattttcttgcttttggcgttcagcgcgccgcggaaaatccccgggaagccgagaacattattgaccgagcggccgtcggctgcataagcggctccggcttgtaatgcgtcttccggttcaatctccggcttcggattagataaggccagaatgacatgtccttttctgacatcctcttttttaatgagacccggaactccggtggtgctgatcacaatgtcacacgtgtccattaaatctttgatgcttccaagcggctgacctccgtactgagcgaggcggttcattgcgtcttctgacttgtccgttccgcagaccgctttgactccgtatgccataaacatgcggcagatggcgacgcctgccgcgccgagaccgatctgtccgaccttcgcttcttttaaatcaagagcggcgcttttacaagcggaaatggcggcggcgagcgtgacgaccgccgtgccgtgctggtcatcgtgcataaccggaatatccagttcttctttcaggcggtcttcaatatcaaagcagtgaggcgaaccgatatcttcaagcagtattccgctgaaccccggagaaatgtgttttaccgtgcgaataatttcttccggatcagaggtatcaagcaaaatcggaattccgctgatacccgccagctggtcaaaaagcgcggctttcccttccattacaggcattccggcgacagaaccgatattgccgaggcctagaatcgccgtgccgtcggtgacaatggcgacagaattgctgattgtcgtatagatggacgctttttcaggctcgttttcaatcagtcggcacacatcggcgacgcccggtgtataaacacggccaagctcagccaatgtccggatcggcattttgcttttcatttgaattttgccgccttcatgagcagagagcacttcatctgaaactgtatgaagccggatgccttccccgagagcttcaatggcttgaatgatttcctgcagctgctcttcattttcggcctgcaccgtgatgttgcgcattgtgtagttcgggccgactttaacggtttcaacttccccgatatctccgcccatcactccgatggcggttgccacttttccgagatttccgggaacagtcggcgtttcaatcattaacgtccgaatcatatgctttgtaatcatgaaatgaacctcctaacccaatttttgagattgcaaggatttttctttcgtgtaccaaatgaatttccccgtgtatccgtacaatattgccagtccgatagatacaaaactgagccacatgaacggcagatatgaaaatgtggatacgccgagaatgccggccatatagatgccgttatcagaccacggcaccatccctgaagtaagcgttccgcccacctctgcgttccgggataaaactcttctgtcaagtttcagtttatcataactgttctccatgattttcggcgtcaggatcaatgacacgtacatcgcacagccgaaaatgtttcctaaaagggcgacgatcaatgtcgaaagcgtcacatttcccggtgtggtcagctttttctcaaaagttgagacaatcacttttaatacgccgagcttctcaagaattcccccaaaaccgagaccgaacagaataacgactaacgtatccagcataccggtaatgcctccgcggtttaacaggccgtttaaaaattcgacgtccgttttaatagaaaaaccattataagcagtcgcaatggcatcggcaaaattcattccctgaaagacggaagcccagattgcgccaagcaaagcaccgatgacgataacgggcatagacggctttttcaaaatcagaaggacaacgacgacaacagccggaatgagcatccatatatgaatatcaaacgttttctgcaatgaagactttaaaaattccactttgtcgagatcaatattttttccgccgtatataaatcccgttacggtaaatagaatggccgtaataatataggacggaattgacagatacatcatcgctctgacgtgcgacagcacatccaccttagaaagcgtggaggcaagcaccgtactgtcagacagcggtgaaagcttgtctccgaagtaagcgccggacaaaacggctcccgctacgatcggaagcggtatacccattccctctccgatggcaatcatggcgatccccgcggttcccacggttccccacgacgttccggtcgcaacggacataacggaacagataaccagtgtagccagaaggaaaatatgaggattaataaactctaaaccataataaattaacgtcggcacaacgccgccggcaatccatgtcccgatgagcgcaccgaccgaaacaagaatcaacaccgcttcaagaccgtttgatatcccggtgacaatcgaatcctgcaagtctttatatgaatatcccagcctgactccgagaataatagcgaaaaaccaagatattaatagagctagctggatcggcaggtctaaaaacactgtgaacgataagacaagtgctaaaaacccgaataataagataataatttccaataaatttggcaatctgacctctttcacaagaaaatccccctagaagaaaaaagctaaaacgctttcatcaaatgatataacaaattatactatactgcctcatccctttgtatggcaaccgcctattcactgaaaaacgtgaaaaggcggctgttgttactttaaaatttatttttctaatagatcttttccggcaatccccggttttgtcatttcatacggattcaaaatgatatccaattcttcttctgtcagtacatcattttgaaggcaaagatctcttacagattgccccgtcatgatggcttcacgggcaattcgcgcagccgcttcatacccgaggtgcggattgaccgctgtaatgacgccgacgctcttttccacgtattgcttcagacgtttttcgttggcttcaattcccgccagacaatgatcggtaaatgaacggaacccgttattcatgatgctgatggattgaagcaggttaaatacgagtaccggctccattacgttaagctccagctggcccgcttctgaagcgaggcagatcgtattgtcattcccgatgacctggaaggcgatttggttgatcagctctgccattacagggttgaccttcccaggcataatggatgatcccggctgacgggcgggcagtgaaatttccgcaagtcccgcgcgcggacctgaagccattaagcgcagatcgttggcgattttagacatgttcatcatgcatactttcaatgcggctgaaacttccgtatacgcatcagtgttttgtgtggcgtcaaccaaatggccggcaccgacaagcggcagtccgctgatgtcagccaggtgctttacaacctgttctatgtagcgcggatcggcgttaagtcccgtacctacggccgttgcccccatgttgacttcatacagatgctggcgggattgtttaattcgctttatgtcacgctcgagcacgcggctgtatgcttcaaattcctgtccgagacggatcggcacagcgtcctgaaggtgtgtgcgccccattttaatgacagaatcaaattgtttcgctttatccttaaagacactcagcatatgcgccatcgtatcaaggagcttatccaaaagttttaaggtggaaatatggattgccgtcgggaacacgtcgttcgtcgattgtgacatgttgacgtgtgtgttcgggctgaggtgaatgtattcaccttttttatggcccatgatttcaagggccctgttgccgattacttcgttggcattcatgttcatggacgttccggctcccccttggatcggatcgacgatgaattggtcatgccatttcccctcgagaatttcatctgcggcctggacaatcgcatttccgattccttcatacagccgttttacatccatattggcaagcgccgccgcttttttgacgatggcgagcgcattaatcatttcttcgtggatgcggtatccggtaatcggaaagttttctttcgcgcgcagcgtttgtattccgtaatacacatcagcttcaatttgtttttctccgaggaaatctttttcctgacgatattctttttgcgcgtttgtcatgctaaaaccctactttctctttgtggtagtcatgtttttacagtacaacgtcgtctgcgatcggtgtctccataatgtttttgacttcagccaagttgtgagactggccgagcgcccacattaatttcggcacgatggcttccgtgttcatatttctggagcggataatgagatcttgattgactcttcggccgacttcatagacgctcatgtcctctccttcttcaagacattgtgtcgtaatgacgacgacaatgccgctttcaatcatttcattgactttggcgagaatgtctcttccttcaaacggcacgccgccgctgccgtagctttcaatgacgattcctttgtacatgccctttaatgcgtcaaacatttccggtttcagccccgggtggagcttgagcaggcacacgtccgtgcaaagtgatgtattgaccgtaaaggcatcgtcttttggcatgtgcacttgtttgttgtattcaattccgttttcggtaataaacgcgatatacggatagttaatgctctcaaatgcatcatagcttttcgttcttaatttaatggcgcgtgtgccttgaatgactctgccgtcaaatacgacgtatacgccgcccaccccttcacatgcgaagcggatcgcgtccgtgatattttttttggcatcggttttttgaaatgtaatcgggatttgcgaacccgtaatgacgatcggtttatcagcatgctgaagcatataagacagtgccgctgatgtatacgccattgtgtctgtcccgtgcgtaatgacgaacccgtcatatgcgtcatatttttctttgacagcatttgcgatttcggcccagtattcaggctgcatatttgtgctgtcgatgttcattaacgaatgggtttccatcgtgtaatcgttatcaagttttgatacgtaggttaacaattcgtctgctttcaccccgggtgcaagcccgttttctccttcgactgaggcgattgttcctccggttgttaacagcaataattttttcataccctgcacctcttcatccatttctcaagatgtgttaagcattcgcttttcgcatacttttaatcaaattatagacagacgattgaaattaatcaagtgattattattcaattcgcgtacacttttgcatatcgatatgatataatttgctcaagtgaaaaggagcggttttgaatatgaatttagatcgtttaactgaactgagaaaaaagaaaaattggtctcttcaatatacggctgaccgtctcggcatcgccaaaagcacgtacgccgggtatgaatcaggataccggcgtccgtcattcgaggcgctgggcacgcttgccgatctgtttgacacgacgtgcgacgatttactggggcgcactgaaaaaaaggcggagccgtttacccagaccatcgaattaacaaacgccgcacaaggccgcggcacactgaccgttgacggacagccgctgaatcaggatgaaatcatcgaattgattgcgtttgtccgcacgaaaaagaaggtgcaggaggagctccgctaaaatccggcttttacggcttgattctgccgtacgtccctccgcccccggcctcaaggacgagctgcccggtgcgcgctttatgaatgacagccgctattttaggctggacgacacgcgccaattcctcttcttgcgcctgatgaagaatcgccatctccgtcccgaaagcccgcttcagtttgtctaacgttttcggcccgacccccggaatgaactgcagcgggatttgatgaatatacggcggccgcggcacgcggctttttttcggtccgctcagttcctccagccgttcactgaccccttttgtcattgttttccccccgcactccggacaggcggaagctcctttttccactgggccgccgcagcggtcgcaagccgtccggtaatacttcccgagcttcgggttcagcccgtaattcgccgtgatttttcttccgtccttcccttttaaagccagcgaaaattccgtgaaattcgcttctttaagaagcatttcattatattctctgccgatttttcctaaggaatgcgcatcagaatttgttaaaaatgtatacggatcaagttccgttacccgcgaagccatgtcggtgtcacagcttaacccgagttccgccgcgtcaatgagcgccgggtcgaaaacttctgtcaaagaagatatgaccccttttccgtacaggcttttatgcggggtgaacatatgggcgggaataaacagcccgcccaattcctttgttttcctttgaagattcaaaccggtttcataaatacgctgggaactgagatggatatttttaagcctttttgcgagccactcagaaaacatcttcatttcggcaagagacggcataaagacgagaacgtgaatcggcccgcggcatgtgtgatcatagatttcaagctcactgcccaacagaagcgtcgtattccgataccggatgccgccttctttcagctcacggtatctgccttcatcaattccgcgctcgatttcttctatgacttccggggaatggcagtcgatgatgcccaatagttcaattcccttcccctcactggcctcttctaaaatccgatgcagcgtcaacgttttggccccggtgattttgaccggttttcccgtataggtgcggccgatatgaatatgcagatccgcatagatggttttcatcatttttccttcagcgcttctttcagctggagatactgaatcgcgtacgccgtttttgcgtcatacaccctgcgggattcaatcagcttcacggcctcttcaagcgtgacctgcatgacttcgacaaattcatcctcatccagttcgcgcttttcttccagcggcgaaagcccttccgcaagaaagagatgcacgatttcatcagcaaacccgggtgatgtataaaaagcggtgattttcgtcaaggtttccgccgtatatcccgtttcttcctcgagctctcttaacgccgtatgttccggctcttcccccttttcaagcttaccggccggaatttcaacgattgtccgttccagcggctttctgaactggttcaccaaaatgatttttccttcctcggtcaccgcaagtacggccaccgctcccggatgtttgacgatttcccgcttgcttgtttttccgttcgggagctctacatcctctaagtaaagatctatgactttcccgtcatacagcttttttttcgcaagtgttttttcttctaaatgtttcatcatgtcatctcccgttctgtctctctattatgcctcatatattttatcatacatgcatgagagggaggtgcttttcgattgaaggtgtatcggaaggataaaagtatcgtattggtcggaaaggcgtgggaagtgcgggctaaactgaaagaatacggacggacattccgctatgtcggagattggatcaccgggccttaacagttgaaaacttcgcgcctttatattacggtcaataaaagactataaaaaggagcgaaacgatgagaaaacgcacactgggacattctgatttagaaataagcgaaatcgggctcggctgtatgtcgctgggcacagataaagctgaagcgctgtctattttggatgaagcgatcgagcttggaatcaattatttagataccgctgatctttatgatttcggcagaaatgaggaaattgtcggggaggccgtcaaaaaccgcaggcacgacatcattttagccacgaaagccggaaaccgctggaatgatgataaagacggctggcattgggatgcttccaaaggatacataaaagaagcggtcaaaaacagtctgcgccggctgaaaacggactatatcgacctttatcagctgcatggcggcacgatggaagatcatattgacaaaacgatcgaagcgtttgaggacttaaaacaggaaggcgtcatccggtattacggcatttcctcgattcgtccgaatgtcattaaagaatatgtgaaaaaatcaaatatcaccagcgttatgatgcaatacagcctgctggaccggcgtcccgaggagtggcttccccttttagaggagaacggaatcagcgttgtcgccagagggcctgtcgctaaagggcttcttacgaaaaaaccgcttgatcaagcagccgcaagcgtaaaagagaacggctatttaacatattcttttgcggaactggaagaaaccaaaaaagcgatcagcgctgccgcacctgacttgagcatgacggagctttcccttcaatacttactgtcacagccggccgtcgcttctgtcatcaccggagccagctcacttgagcagctgagagaaaactgttcggctgcagaggcccggcgtttaagcagccaggaaatcaaagccctgcaataccatacaaaacgggacgtatacgaagcccatcgttcttaaacaataaaaccggcaccttgtcagatgccggtttatttatatttgtgccaatcgagactgctttcattcagcagctcttcaaagcttttatttttttctttttcttttcgttttctgatttgttccgctttttgctgcgcctgttttttctcgtcttcttccttcagctcacttttcatttgcaaaagcctggccttcagatcttcccccagatcgtcttttaagctgtgtttttctttaggcagctgctttttcatcattacgccccccgtatctgaatatggtgaagcaagtgtaccacggagcgccggaggccggcaacgttcacggtcctgaaaagccggaggaaggatttttcatatgaaaggagggtgcctgtgtgaaaaaatggctggcggtgttcggttcggcttgcgcagtctttttggctgccggattcgcttttacgaatctgattatgtttatgaagaaaaagacggatgaagatatcatgaaaaaagaaacggccgacgggcatgatagatttgattcctttcaggccatggaaaaagaagaggccgtcatcctgtcacgccacgggtatgagatcaaaggcttttacgtcgccccgcatcatacggcaaacaccatgattatttgtcacggcgttaccgtaaattcgttcaattcattgaaatacatggatttatttttagatttaggctggaatgtgctcgtatatgaccaccgcgggcacggaaaaagcggcggcagaacgacgagctacggctattttgaaaaagatgatttggaagaagcggtgaattgggtgagacacaaaacgggagacggcggtcaaatcggcatccacggggaatcgatgggagcggtgacggccttattatacgcgggcgggcatcaggatgaaaacggcgctgatttttatattgcggactgtccgttcgcaagctttcgcgatcagctcgcctacaggctgaagcgggagttccggctgcctccgtggccgcttctgcctttggctgatttctttttgcggatgagagaaggataccgtatccgtgatgtatcgcctttatcggttatcagccgaatccggcagcccgtgctgtttattcacagtaaggaagatgattatatacctcccgcttcttccgaattgctgcaccgcagaaaacgcggcccgaagatgctctatctggccgaatcgggcgggcatgccatgtcgtacaccaaaaatccggagagctaccgcaaagccgttcaaacctttttagataccatgacgcaaacgtaaaaaagcgaaagaacgtatgctggttctttcgctttcccgtcataaaacgtcggtaatcccgtccatattttctccgatccagtcaatggcgaggtcgattgtcgtaaactcctgcgctttgaaggtcatctcatcctgaagcagccagacatccttctgaacggattcagcgcctccgatggaccagtgcagcagactgtacgggtggttgttgttcagaaaggatacccacgttttatgctgtgccgtctgtttaatggctttcagcttttgattcactttccgtttctccctgctttactaatatgctcattctcgggctcagcatctctgccgggctttttaagacgagcgtttttgccttttcattgtaatcgattgtcatttcctcgtcaaaaaacactttttgtgaggtctggatgtaaagcggaagtccgttggtttcaatggcctcgcattgtcccgttaattcgtccgccagccagatggtcggcacgccgctcaccgcgcacccgcagccttctgcgtcatagcggagctgcgctttttttcccgggttggcgtccatcgcctgctgaagtgtgtgtttcgccgcatccgtcacatgtatttgcatagatgatcctccgtttttcattttcgccattgtagcataccggagccgctgtatgcattgtttctgctttctttacagcagcctgctctcccagtcctttgcctcttgttcagccgccttgatccagtcatttttcccttcactatacttttccatatcgtatgggtatgcctttgcgagccgccgtttcagttccatgtattgaaccgctttttcaggctttgcagtgaggtaatcccggaacagcagatgacgcttcacatccggatggcctgtttcgtatatgtggatgtggtgtgtgcgcttgctgccgcctttttgaaagaaacgccggccctctatcccgttttctcctttcgcctcatagccgagtgcttccagctgcggactgaatcggtcagcgtccgaaatatctttaacctccgccagtatatcaatgacgggttttgcggccattcccgggatggaggtgctgccgatatggctgacagaatgaagagcggggccgaagattcggatcaagtccgccttctctctttcaaacatctctttccattccggcttgtacggaacaacttccgctttcctcttcggataaagatgaaaaaacgagagggtcagcccttccggcgtctctgtctgtccggcttctgtgaacccggtttttaaatagagagagactgccggaacgttttgactggcggtagccgcctctattttttgggcgtcccggttttgatctatcacaaattgaataagtgcccgtccgattcctttccgaaaggcggacgggtgcaccgtcagcctgcatatgacaaggtcatacccctttttttcatacgaaatgacgcctgcaagccgatctttttccttgaaaccggcaaacgtctcccgtgacctctgtatgtcaccgggtgtttcatgcagggctggaatgccgaaaaagccgatcagctcggcttctttttgataagagcaacgttgaaccgccgcaatttcccgcgccgtctgttcttgtgtatgccgtaaaaatgtaatcaatcttccgccccttttgacgcaaacattcgctgtgactccgtcttcgtaatgcggaccgcgtacgcttcataccaggcgctttttcctttttgttttgccgcccggtggtcagtatggtctttccaccttttaatcgcctccaggctgtcccagtaggaaaccgtgatgccgcagccgttttcctcccgaacgctttccgcgcctaaaaagcccggctgtccgcctgccaaattcatcatgcgctctgccgtatgctcatattcctcatcatattttccctttattgatgaaaaaatgaccgcataatagggcggtttgggcgtgtcagctaaaaaacccatattcatccccctctacatatatttcacaaacagaatccggtcttctcccggaccgtcataattcgcaaaaacagggattccgtttacggttttggttcctttttcaacttcaaagcctaattttgtatgataagcgattgatactttattgacaggcgccgtcacgcaattgacttttgtgcagcccctttttttcaccgtctccataaatcgatcgtagagctgttttccaatttgcatttttctgaaatccggatgcacaccggaaaaatgaatgtaggctgtctcagggtctgattgtgactgaaaaccgattaaaaaaccggtcattccctccggcccgtacgtgataaagcttgtgtcctgaaaatgttcaaaaaacaagcgcggcagtttgtctttcatctgcctgccgccccaccattcattcaaaacagacgtaaccatttcatagtcttcagaggtaattgttcgaatatccattatcgattgactctccttttcgtccggcaaaatgaatgtcagctcttctcattggaatataaaaaattatatgtgggttgtttgcaattgtaaatgatttcttttcaagcaaacgaatcagcacgtcttccagccggggaatgatttaccagtataaacgtgatcattgttcgggtacaatgaaaaaaagaacaaatgttcccggaggtttttttatggctgatattcttcttgttgatatgcaatcgttttatgcgtctgtagaaaaagcggaagcgcctcatctcaaaagccggcccgtgattgtctcgggagatcccgaaagacgcagcggcgtcgtgcttgcggcttgtccgctcgccaaacgatacggcgtaaaaaatgccgaacggctgtgggaagcgcaggccaaatgtcccgacgccgttattgtccgtccgcggatgcagcggtatattgatgtatccgtcatgattaccgaactgtttgaacgatataccgatcttgtagaaccctactccatcgatgagcagtttctcgacgtgaccggaagcaggcggctgttcggtgatccttttacaattgccgaaagcattcagcaagcgattttgcgtgaattcggaatttatgcccgtgtcggcatcggaccgaataaggcgctcgcgaaaatggcttgcgaccattttgccaaaaaaaacgcatccggcatctacagattggatatgtcaaatatcagggaggatctgtggccgctgccggtcggaaaattattcggcatcggaaaacggatggagcatcatttaagacggatgggcatcagcacaatcggcgggcttgccgggcaccccgccgaactgctgaaaaaacgctggggcattaacggcgaattgcttcagcggacagcccgcggcatcgatccctctccggtcaccgtcaacacgcacagccggcaaaaagcgatcggccataacatgaccctcccgagagactacagccgctttgaggatatcaaagtcgtgctgctggagttaagcgaagaagtggcccgccgcgcccgtttcaaacaatacatcggccatacggtttcggtcagcatcagaggcgctgattttgaattcccttcaggttttcacagacagagaaagctggtctctccgactaatttcggaatggatatttttaaagcggcggtcaagctcttcaaagagcattggaacggtgagcccgtccgcagcgccggcgtctccctttcccagctggagccctgtgattatgttcagctgagcctgtttgatgctcaggaaaaaaagatcagtctcggcaaagtattggatgatattcatgagcggtacggtcctgcgtcgctcctccatgccgcttcactgacagaggccggccaagcctttcaccgggctgaaaaaatcggcgggcattacaaataattgaggtgatatacatgaatccgaacaaattaacacccgggtataatgtcatgtgggaatcaagccggatgatgctgcccgaacatcgggagcagctgcttgcaaaaaaacgaaaagaacgggaattccggcctccggaactgagcgaagagcaactgaacgacatgaaccgcatcattgcggcgtcgattgaagaagacagagccatctcggtcacctatgcttcagcacacggcccccgccgcttttggggatgggtaaaacaagtgaggcatgacgaaaaacgtttaaaaatcataaacgatgaagatgcgttaacgctgccgtttcatcttattctctcggctgaactggaataagagcctaaatcgtcctgacagaaaatatgatagaagagtgggaggatcacatgatatttagtagaataaagatgaatgacaagaataggagaatatatgatggatcaatttatagaaaaaatgctgggacaagccctccgccagtatggacggaatgtgtcgacagatccgctgagcccctatgaaaaacagagtttaaaaaaagctttagaagaaagaaggaatgaagaacccgatgaggatctccatgcccatgtagaagatattatctacgattacgtcaccaatcaggggcagttttcctgacacggacgtttatgcactgggcgataagggaaacgtccgagagtaaacccttaaagattgcgtggtgcaggatatgcctgtcgggccttatttcaagatcggttatgccgttcttctgttatttctcatcatttatctcggaacattaatagactttttgttccagcctgttgtgattacggttaaaaccttgtttccgcccattgtattatcgggcgtcctttactatttgtgccgcccgctcgtcagagtgctgcatgcgaaattaaagctgcccgaaggaatcgcgattttagcgatttatgcgggaacagccggccttcttgtcctcttcctttatacggcgggccctgccgttcaaaaacagtttacagccttcacagaacatattccggagctttccgcaaaagctgaaaattggatcgggcatcttcaggacagcaaatggttttcccggcttcagcatggggattcctttaaaaaattagcggacaaagccgcaaattattccggttcaatcactgattctctcagcagcctggccggtacggctgccaatgccgccatcaccgcagccattattccgtttgcgctgtattacatgttaaaagaaggaaataaagcccccggcgactgctgcggcttcttccggaaaaacatcaaaaagaaggaaaacaaatccttcgggacatggatgaagctctcagttcatacatacaaggacagctgctcgtcagtttctgtgtcggcgttctcgtcacaatcggctattttatcatcgggctcgattatccgctcgttctgggcgcgttcgccatggtgacaaatctgattccgtttatcgggccttggatcggcacatttcccggagtcattgtcggattgttcgattcaccgaccgaggcggtgctggtgattacggtcgtcgtcattgtccagcagcttgaaagccagctgatttccccgcaaattatgggacggaagctggacattcacccgctgaccattatttttcttctgcttgccgccggcaaattctcaggaattgccgggatgctgctggccattccgggatatgcggccgcaaaagtggtcataagccatatgcagaaactattcattctcagaaaaaaacaaagctaggagagaaatgattcatcccccatgtcttcacatcggttaaaatgaaaaaacggcgggctgaagaagcccgccgcacacggaggtaaaaaagatgaacatcggtgatgtcatttttcaattgatctcatttattgcagccgcatttttcctgtttgccgtgatatacgtattcagaagcttgaagcagcgccgcatacaattggacagaatcgaaaagaaactcgacgcgctgcgcgaagaaaaaaacgagaagttatagttcattcagaggcaggcgcagccagctccacctttatccgatccgggtcctccgtgtatacggcgtaatgcgtgcttccgcctgcatatggatggcggtccctgtaaagcacggggcatcctctggcaagcagcttttccgtcatctcgtcaacctgctctcttgatgcagcatgaaaagccagatggttcagcccgacccggcatctgtggtactccggtgttaaaaaacgctcctctgtctgtacaagcacaacataaaatcctgcgtttttccagctgatgccggagtcccaattttgaaactccctataaccgagctcacctaaaaaccatccccaaaaccgggcggaggctttcaagtcagatacatacaattcaatatgatgcatcataatattcgcttcctcctcatatcacacccgccttaccagcacctcttcaactttatggccgtcaccttttctcaaaatcaaatccgatctgaattttgtcggcaggatattttcatacagattcggacggttgacgctctcccaaatggaggcggccatggtatccgcttctgcatcagacaaatccttaaatttatgaaaataagaagccggatcctgaaaagcggtttctcttaagaggcggaaacgctccaaataccacgtgaaaatccggctttcttcggcatccacatagatcgaaaaatcaaagaaatccgatacaaaaatccgcggatcttccctgtcgtcctctaaggtcggcgactgcaggacattgattccttcgataataacgatatccgcaccttcgacaacctcgacggcgccctcttccctgtcataggtaagatgggagtataccggcgcctccactctctctttccctgactttatatcgttcagaaactcaagcagcgctttcacgtcgtaactttccgggaatccctttctggacagaaggtttttcctttttaattccgccgtcggatacaagaaaccgtcggttgtcaccaggctcaccttcggcctgtccggcagacgggaaagaagcttttgcaaaattctcgccgtcgtgcttttgccgacggcgacgctgcccgcgattccgatgataaacgggattttcgctgaatgcggatgtttcagaaacacgttgacatgctgattccgtcttgcggcagacgtgacatgaagatggagcaggcgcacaagcggaatgtaaatcgtttctacttcttccaccgataggtagtcattcagcccctctacggccttggcttcttcctctgaaacggcaatggaaagatggccgccgaatccggcccacgactcgcggctgtgctgcgtatacaatgtatgtaagttcaattctttacttttcacaattcacaccaatctctctgtatggctttccgattaaaaaacaaacgcttacaaagattgtaacggaaaaccgcctcactgtctgcccatttttttcacaaatgaggaaccgatccggctgtactcttccatttcctccttgggaaccatgcttccgccggtgctccacacaaggtgcacggcatttttcatctcaagcccccgctcttttatataacggttaccggcttcggtctgaacgaacttgacggctccggccataccggcgagtgcagagggttcaaggctcttattctcggccgctcttaattgataaagcagcgaaaaaagcgtgccgtcatcagcggtataacagccgctgagtataggctccatcagagggccggccagtccggacggccttcctaccgcaagtccgtcggcggctgtttgattatcaaggccgatatcctgcacgctgattccgtcatgcaagccggaaaacagtcctaacagcatacacggtgaatgcgtcggctcaccgaaaaaaatatggacatgcccgccatagatcagctttagcgcaagcgcgacgccgcccgggcctcctccgaccccgcacggcaaataaacgaaaagcggttcatctgcaccaggctttatgttcatttgatcgagctgctttttcacacggcttcccgcaacggcataccccaaaaacagatcccgggaatgctcatcatcaataaaataacaataagggtcctgcttcgcctgcatgcgcccctctttgacagccagactgtagtctgcttcatattcgatgacgcgaacccccttttcccggagcagctcctttttccactgctttgcgtcactggacatatgaacggtcacacaaaagccgagcttcgcgccgattatgccgatactcagacctaaattgcccgtagaaccgacggctatagagtattttgagaaaaaagcggtaaaccgttcctcagtcaatatgctgtaatcatcgtctgttgagagcattcccgcttttaccgcgaggtcttcggcatgcttcagcacttcgtaaatcccgccgcgcgctttaatggaaccggaaatcggaagttcgtcgtcgcatttcaaaagcagacgcccggggaaagcctgagcagcgctttgttccagacgctttttcatttcattgatgaagacaagcggagactcaatgaggcctcccgccgcttccgtctccggaaaagccgacgcgatataaggcgcaaaccggcgcagcctttcttccgcttcggcaatctcctttttccattcagcgccattctttactggatcatcggttttatgcgggttgatccaaaatacttcacgcgcctccgccatttgcctgactaaaggctctgccatcaatgccttgtgtatatcccggtcggacattcctttctcccccttgttactttttctttaatgcgcggccggccagtttttctgtaaacgaagggaaaagctgatacagcttcgtcccgaggctcatccatcgcggaagattcatttcccgtttatccgtcagaattacggatgtaatacgctctgccacatggtcggcatcaagcatccatctgccgacgcttttcacataaccgccctctttatctgcaattgtaaagaagtctgttttgatcggaccgggattaaccgttgtcacagctacacccgtaccggccagttcaagccgcagcgcattggaataccctaaaacggcgtgtttcgttgcggaataaaggcttgatttcggcgtcgccaatttgccggcctgtgaggcgatattgataatatggccgcttttcgcatgaagcatcaccggaagacaggccttcgtacaggcgattaatccgaagacgttgacttcaaacattgccttcatatcatccaaagatgaatcagcggccgtttcaaaaatgccgaagccggcgttgttgattaatacgtcaacatgaccgatcaaacgccttacgttttcagcctcttctgcatgccggacgtcaaacggaatgacatcacactgtccgccgcgcgcggtaatcgtttttttcacttcctgcaagcggtcctcccgcctggcggataaaaaaacatgagccccttctgccgcgcaggaatatgcaagccgttctccgagtccgccggatgctccggtgatccaaatccgcttatccgttaatctgcccatttccttcaccccttcacagctttaaacatcagagtgcttcccgactgaaaggattcggccttcccttttgcagccagtacgtcaagatggccgatcgtttctgacatcgttaaaaataattcattttcgtacacagccggaaacagccgccggcatacctggaaagccgtcagcgtttcctctgacaacaggcgcagcacatattccgaccgatttctctgtttttcaagccgcctgtcaaaagcaggctttacgtctgtcagcagatcgccgtgtcccggatataaaaaggacgggtttacgtcatacagccgcttcattgagttcaagtagtcgagcatcggggccgcgcgcacgccccccttttccggagcttccagaatcggattggtggagctgttggacaaaagcagatcgccgctgaacatttcaccgcttttttcatggtagagcgcaatgtgagaagcggcatgacccgggatttcgagcaccgtccagccgttaagcccgtcgattttcccgccttcttccactgttttcgttaacggacggtttgctgaaaataagtatgacagcttaactgttttatgtatgtcttcaggcgtcaggggaacgcccatttcagtcataagcgacagaaaaaagtcctcctgccgggcgatatacgactgatcctgagtaatgtacctgtcattcagcggatgcccgatcacttccgtatcctcggaaaaaaggtgcagcagacctgaatgatctgcgtgatgatgagtgagcaccacctgttctatatccgccgcagaaacgccgtgttccttaagctgaaatgagagcgattcagccgcttcctttgtattcggtccgcaatcaataagggttaaggcttcatcttttattaaataaacgataacgtcgccgactgcaaacggagtcggcacacgtatcggaatgatctttctcgctgccatgtttacgctccttcgttcttttcattcctgaataatcatattttagcgttttcttttcactgtgtcattattgccgcatatcggaaaaaaagattgacatcccgctctttcgcatagcataatgaacaacaaactagaaaacacggaacgcgatgacgaggaactagtatataaacaacggcagcagagagcaatgtccccggctgaaagacattgcggccctcttgtttacagaacctgccctcagagcggttaggaaaacctaaacgtatcccctcgttacgggatttgagctgagcacggctgattcgtgctaatgtaaggtggtaccgcgaaaccttttcgtcctttttgacgggaaggtttttttgtgttttagaagaaggaggatttatatgaagaaaatcggttttatcggggccggatcaatggcggaagcaatggtgaacggactgctgcaaagcggaatgacagcccccggacatatatatatgacaaaccggtcaaatgacagccggcttgaagagctccaaaaaacgtacggagtgaaaccgtgccgggataaagaagagtttttcagcaataccgacattattgttctcgcctttaaaccgaaagatgcggcagaaagcattgagaacattcgcgaatacgtgaaagatcagcttgtgatttctgtcatcgcggggctgacgattcacacgattcagcaatatttcggcagaaagctcaccatcatccgggcgatgccgaatacatccgcggccattcagcaatcggcgaccggtttttccgcaagctccgaggcgagtgaagctgaaatccggacggcaaaagagcttctggaaacaatcggagaagcgacgctctttgaagaaaaacaccttgatgccgtcacagccattgccggaagcggtcccgcctatgtgtaccggtatgtcgaagcgatggaaaaggccgcccttcaagccggcctgccggaagaaacggcaaaagagctgattttacaaaccatggccggggcgacggaaatgctcagaacaagcagcaaacggcctgaacgcctgcgcaaggaaatcacaagccccggcggcacgactgaagcaggccttcgcgcattagacgagcgccgctttgaagaagccatcatgcactgcatcgcagaaaccgcagcccggagcgccgaaattaaagaacaattcgcaggctccgttctgcaaaagacagaccagtcataaagcatggggcatcccatgcttttttcattctgtttaactgccgtataaacggctgattctctcttttacttcaggaagatggaatgtggcttcgtgcatgtttacctcttcctcaaccgcttttgccagctctcttttgatccgtgcggtcacattggttttcagcgcaaccagtgaggctctcggtttatccgccagcagccgggccaattcgcggcctctttgaaggacgtcttttttcggcagcacttcaaacggaacaccccgtttttccagagcggcgccgctgaagttcgcggccgtaaacagcatttcttccccgaggacaattcccagtttttcaggcacaatatacgtcgcgcccattcccggtgtaaatccgtacttcatataattacaagaataaaaactctctctgcttaaaatcacgaaatccgagctcagaccgatcgtaaagccggctccgatcgcatgcccctgcatgacggaaatcacagggatcctgcaatccaataaaagactgtgaagctttaaatctgtaaattgaagctttccgctctgaatggtcaaaagcccctcctgcgttcctcccgtgcagaaataatttccgtaacccgtcagaagaacggttttataggacggatgggcattgatgtcttggaatacccggtgcagctctcttacaaactcttctgacagcccgtttttcccggccgtatcctgcattgtgacctgcacaatgcccggttctgtttcctgtacatcaatcattggattcatgtttattctccgtttctttaaaaatactcaagtctttccggctcttatactaggtcgtccattcatactttctgtgaaactcttttatttcagtcagcactaatcgcgtttttccttgatgcgcattcgggatgtctgctgcgggcgcggcatttcttgtgccgaattttacgatgccgctgtcttggagcagccggtcataatcagccatcgataaacggacgcgttcatccaaatgccggctgatctgaaattgattctgccgggcacggctttgcggcataacgacaccgctgtaaaattcagagcagcagcccgaaccgtatgaaaaacagccgacgcgtttcggcgtttcaaaagagccgttatcaatcgtgctggcaagagataaaaatacggtggcccccatgatgttgccgacgcgctgacagtattgaatcccaggcagcacgcgttgctgaaaatccgcttcaatgtcctgcggcttagcctttgccaattttctcatcatcgtccgatgcgctccttttaccattccgccaaacggagtatgaaaagaaaggtattgaaatgtattcttataatccgccccgctcacacgctttcggtattcctgaaatgaatgttcacagcaatccaaataagacatgagcgacagatcagcatcccccgcttcactatccggaatcgggcggcaggtatccatgacttcatacccgtaatacccgcttgcgccttgatcaagcaaaaagacatgaggggtgctgctgactaaaagcgcgacagctcccgcccccgcactcggttcggcataggaccattcctccgtcaacgcatcaccgccttcagccactaaaaagcgggaaatatccgttccgatgatgagcgctttcgctcccggcgatgtttgcgacaagatgaaattcacgcccatttggaacccggccgttaaggaatagcaagcctgtttcacttcaaataaccggcaattccgcttcagctgcaaataatcatggacatatgtactgatggatttgccaaaatcaatcccggattccgtacaggtgatcaccatttcaatctgattccgttcttcttctgacagagaatcgataatcggttttgcggcatttacggcgaacgtaatcggatcttcaaacggaagcgccaccactttttctttcatcagcaggttctcaaacctttttttatccaggttccgatgttccgcaagctccatgacgtctacatacgcggttccgccaaacacgttcattgcttcgattcctacattcatttctccaagcccccagagtaaagaggcttcccgtgaagcctcttttattttttcgttcaaaactcaacaagcagccggtcaacgccgtgaaatacagggctcggaaccagattcggctcttgatcctcagtaaaacgccatgcgggcatctgttcaaaaaagtgggaaagcgcgattttcgcttcaagccgggccagcggcgctcctaagcaataatggctgccctgaccgaatgacagatgctgattcggctttcgtcccaagtcaatctgatcggcattttcaaacttcttttcatctctgttcgccgatccaatccacgcatatactttttctccggccggaatcgtttttccgccaatctcgctctcaaccgcggtgtagcgggttacccgctgaatggaaggtctgaggcggatgacttcctcaataaagtcaggaaggagcgccttattttcaagcagccggggcagaatatgcggaaactccttgagactgagaaatgaatttccgatcacattttccgtcgttacgtgccccgcgacgatcaacaagccgcaaaaaccgattaattgcttgtctgacagcggctctccgtctaaatcagctgcaattaaatggctgattaaatcattttgcggctgttttctccgctgtaaaataaactgcatgaagtatccgatcatctgcttttgcacttcattcattttcttttcatcttttacattctggctttggtcgacccagcttttaaagatatccctgtctttcggaggaaatcctaaaagctctgcgatcacgataatcggaagcggaaatgcgtaatcttcgataatgtccatcctgccttttgaacggacggcctgaagcaggtcatcagcgatagcggctatacgcggtgcaagagactcaaccgatttcggcatgaaaggctgattgaccaattttctgaagacggtgtgttcaggcgggtccattttcaaaaggctgtctttgttaatatgccggatcattttttcctgcttgtccgcacttaagtatttatgatcggaagaaaaatgactgtagtcagaaatcacccgcttcacttcatcataggtgaagatttcccagcaatcttccttttcattgtaatgaacgggagaggtttctctcatcgtttggtaccatttgtacggctgctgctgtctgatttttgttaaactggtcattttcattcctccaagatgtgttcaagatttgaaatgacccgccaaagcttacgagtaaacccggcgggcggatatgtgaatttacggtcttgttttggcgggctgcttcagcatctcaccatgcacattcagtatcttttcctgcagctgcagaaagctgtgttctgtcattccgtctgccgaatataaaacgccgcaaaattcagaaatcgtttcggctgcgctgtcttcagccaataacgtcatatggttggataccgccacatccatgatggcgatgtttgtcatatgctcttgccactggctccagtagttgacgaaatcagcggataaaatatcggccctgatcgtaaaatacggatcaagctcacccaagaaaataccgtttttatttcggaaataatagcatgtcaccccgttcggatccggaagcggcaggagttcgtaatcagtgatttcgtaagcgtcctgaacgtttatattctgcctgatcagatttttcaccaacgcgtccgtcttcgttaacccccgctgtttggcttttgctattaattgctctaaaaatatgtcttcatgaagatcggcatctagttcatcacggtgaatcaaggtttcagaaatgcgttccggatgttgatagattggtgcaaataaagccatgttcaccgtctgcagcatcatatttttatcaaataattcatcaggaatgtttatttcccgcgcacccgccgagtcaaaggagtcgagcatgacgattgactcaacggtttctccagccagctgcaattgccgggtgacttcataagcgagcatgccccctaatgaatagccgcctacatcgtaaggaccccggggctgcacggtacgtatgagcttaacgtaatattccgccatgtttttaatgccgcggatcggttcccggtctgtcatccatcctcttgcctgaattccgtaaaaaggacgcccagtccgttcggcaacaggctggtacagctccactgcccccagcgcggaatgaaaccagaaaatcggtcttccctttcccccgggttaagacagatcagttcgggcggttcttgatcatctgtctcttctgatatatcgttttgtttcgtatgttcctcatgtacttcctcagtgtctttttggacagaaccggtcagatacccggctaattttgcgattgtcggatattcatagaccagatttgccgtaatagacgcttgatacgttttattaatggactgaacccattccacaccgataatagaatccagccccatgtcaatgaatgcctcatgctcatcaatatcttccggcttcagaaacaggatgtccgcaaggctttctttgagctctttgcgcaaagtgccgtcagagatgccggcaaggggagtttctgcttccgggatttgcggacgtaccgctgtttcctccgcttcagcatactcgggtttcgttatttgccccgctatatattccgcaagctcctcaagcgtcgggtgttcatacaccttattggcagtaatctcagtgtggtacgttttatttactgtttgtatccattcaaccccgataatggagtcaagccccatgtcgatgaaaggctcatcagcatcaatatcttccggtgacaaaaataaaatatctgccaggcttatcctcaattcttcaagcaatgttctattgtcttcggaaactgcgttttccggctgatggacagaaacagtacaatccaaaggctgtaacacgatcggtttttgcaatgtctccgattcaaacgctgtcatttcgatctcagttaaaggactcagagaaatcagaccttcatgttcaggctgcggcgaagacgggggaacggtttgcgtttcagactttttcatggcttggcctggtaaagaactgtttacatcagccgcccaatacctttcttttaaaaacgggtaggcaggcagcggcgttttataatattgccctgcgtcaaaaagccgtgtgaaaggaagatcatatcctctgcaaaaaaggtcagcgatatgtgccaggctttctctgtactgcgcgggcgaagccgccgagcggcactgttcaatgcattccattccgaatgttttcattccggcttcgtctgccggcttctgatccttcaaattggacacaaacacacccggaagctctctttttacaagccactccgataatacccgcttcagttcgtccgcactgcttacgatacaggcaaaccggtgatgcagatgctttctgccgagcaggagcgtataacttatatttcccagatcgctgtctttgttcttgctgagtgaatccagcaggcgttctgcctgaatttccagctgacgctccgtccgcgcagataaaggaatgaggcaggccggttttgccggtgaccggcgcacggtttgcggcgcctcttcaatcacaagatgggcatttgttccgctgaatccgaatgaactgatggcggctctgcgcggtgcatccgaattccgttcccacggtatcagcttttcattcacaaaaaacgggctgtccgcaaattgaatatgctgattggcttgatgaaaatgcagggaagccggaatctgccgatgcttcagcgacagcaggattttaaacagtccggccatccccgcggccgcagcggcatgtccgagattggttttcacagagccgatggcgcaatatccttttttatccgtataacggcggaaagcgcgcgttaaggcgctgaattcgatcgggtcgcccagtgcagtgcccgttccgtgagcttccaccatttgaatggtttccggattaatgtgaaaagtatcatagacatgccgttccaatcgttcttgagaaagcgcgcttggagcggttattccgtttgtagcgccgtcctgattcattgcagagccttttatgacgccgtacacatgatctccgtcactgacggcgtcgctaagacgtttcagcaccacggctcccacgccttcacccggcacgaagccgtccgcgctttgatcaaacgtatggcagcgcccggtcggcgacagcatattcgccttatttgacgactgataaaaagcgggagtggattgaatgaaaaccccgcccgccaccgccatttccgtttctttcgtccagagcccctgacatgccaaatgaatggctgtcagcgaactggaacatgctgtatcaacagtgatcgccggaccttgtaaattaaggtgataggcgatccttgccggagtgacggaattatgattgccccaaaaagcctgcgcgggcccctgctgtttaaaaatagcctggtaatctccgccgcaggagccggcatacacgccgcattcccggcctcttaccgagtctcccgcatatcccgcatcttcaagcgctttccatgattcttccaaaaacagcctctgctgcgggtccatataggtcgcttcacgtcctgatatatgaaagaaaacggggtcaaaacattcaatgccctctataaaactgccatactggcattggctgtcagagacatcccatctgtctgcttttttaatcagatcccgtccggcggctaagttttcccaaaactcatggacattctccgattcagcaaaccgcccgctcatcccgataatcgcgatcggttctttttcaggtaacacagctgctgattttaccgtttcggccggatccttttgttcggggcggtacgtcatttgatacggctcagaaacgctgatgacgattttcccgatatttccgcggtcatccagacagtgatacgcttcttttatgtcttcaaaggaaaagatttttgagatgacaggctgaatgactccctcttccgccagccgctgcagttccaattgatagtccttgacctgatccggattttgaagagacagcttccgcaaatccacgctgtgaaacgattgattgttatgaaggacggacaagtcgactgatttagcggatttcagcgcagtcatggcaatttcgatatatcttccgcccggcgccaggcaattcattcctttttgcatggcatcaccggccagggtattaatgacaacatccaccccacggccgccggtcattcgcatgatttccgtttcaaaatcttcttccaaatagcaaatggtattgtggatcccgagcgaatgcagatactcaatttttttctgtgatccggccgttgcatatatttccgcgccgatatgccgggccatttgcaccgcgatcagccccgttcctcccgtcgcggtctgaattaatattttttcgccttttttaagtccggctttccggaaggcgtctatcattgtcaccgccacggtaggaagagcgcatgcttcttcaaaggtcagccgggccggtttatgatagacttgatgttctttacatgtgatgagattcgcctgagagccaaaatcctctcccatgccgacaatcacttcatcacccggaatgacggatgttacatgcctccccgtcttgatcacgacgccgcttgcttcgaatcccggagtgaacggataaggcggcattgtcggatacagccctctgacacaaagcaagtctccgaagtttaaagaaaaggcgcggacggctatttgaacttcgtcatcttttgtctcgggcacttcactgcgggcaatcgtcagatcttcaatgccgcccggacggtcaatcacaacccggaatattcccgagtcatcggactttgcgaaagaagacggcatacgttcttgtttcggtttctgataaccgttttcctttctttccgtctgcaaaggtttttcagcaggccgttcttcctgaagcgccgggcggattttcgctctttcggtctccagagatgaggctatgatggtttcgtattcttccgagatataaccggtcagcagtttcacatgatagtaatcaaataaaatcgttgtctgcagtgtaagattcaatcgcttattaatctcgttaatcacattgacggccaaaatggaatcaatgccgtattcagagaaattcagttcttcctgaatatcctcttctttcatttttaatacatcggcaatacttgttttgatgacagagcggacatgggaagcgaccgattccccatcagccttaacagcttgatgctcctctggcgcgcggctgcgggaaacaggctgtgcgggctttcggaaaacttcggccggcgcggcgtatggctttctgccgtctctgattccttggatccggacgagtccgtcactctcagctgcgataatctgctgacctaaatcatgagccgtttcagcagggaaacaaaccgatctgtatccttccgaatgcagcacacgctcccacgattttggatataagccgggacttcccggaatccgaagctcagcatcctcataggaccaccagccgtcaagcagcccgaaggttaaatgggtaaaaacagaacgatcgctgatttcatttatcagaatcattccgttgtatttcaggagcgctttcagacggcgcagtgtcaaaccgatattttttgtggcgtgaagcacattggcggcgatgacaatatcgtaaacacccgttttgatattttgtgattcgcaaggctcctccgcattaaacaaggctgttgtcaaatacggcacatcaggtccgtattcctgttcggcatgcattaaaaaagctttagaaacatccgtataacaatattccgcaatctgttttgcgaatggtttcagttttgtaaacagcatggcgctcgttccgcccgtcccggcccctacttctatcagcctgatacgggcatcgggatgttctgtaagataggctttcaggtaagcggccgcggaatctgctaacacttcattaaaataatccgcaacgggattatgcttataaacaccttcaacgagccgcattgatgaatcgggaaatacgatatccgtagccggacgttctccttttaaaattgaaggcatcgcttttatcgtcgcctcggccaattcagcttgcgcaagctcccccttgggaagcaggcgtttatgggcattccactcattccagactgtgcggccgtccgggcgctgatccgcgagaagagtgatcgtgtatccgtcatacgcgatatatccgttttcttttaatagattcaggctttcttccagccatctgccgtatgtgccgatcacgccggcgctccccatggatgctgcaggtgtggtgacaggctcgctgaaaaacccgattgactgtaattggtaaaagagcagtttgcaaagaaggctgttcatatgcgcaactccatttctcgttttaaagtctcaagccgttcattccgatccggattttgccgcttgacgctttccataaatgaaggctccgggccggatacaaccgatattgcatcttgatccgtcagtgcggctaagccgtgcggagcagctttgatgaatgccgcttggctgaacggttctgatagtaagacttccagcgcctccattgcttcatcgggttcaatagaaccgatccctgacgcctccatccgttttctgtaagacgggtctgatacaacgcccagactgccccaatatccccaattcatgactttcacttcacaatcaagcaaggaagcgatatggcgggcaaaggcgtcttgaaatgtacaccctgccgcatagttgctttgcccggcattttttgtgaaagaattaacggatgagaaaaacagcacaaaatcaagcggctctcccttaaaagcttcgatcattcggacgctcgtattcaccttagctgaaaaagcgtttctgaaagaagcttcatccatattcgccatacttttgtcggcaagcgttatcgcggaatggatgactcccgttatattgccgtattgctcttttacggaacggacggccgctttaagcgctgcggcatcttgagcatcagcctgtatataatgcggcgcggggcctgatagcgccagcctgtctattttgctctgaatctcctgatccttcggccgcctgccgatccatatcatccgtgccttgtaacgggtgatcatgtatttgctccatgcttctccgatgccgcccgctccgccgatgacagcataaacgccgccttctctgtacgacatacgcggagcggaacttgtcagcacccggactgttttttgcttatgccaagctccgttacggtacgcggcagcatttccgtccggatctggaggaaggcgccagatgtttttcatctcagacgaatcactgccttcttctgcatcaatcagcctgatgtcccagttcggatattcttttgccaatgagccgatcaaaccgtgtacgcctgcatgctcaggctgcggcagatcacccggatacacggactgtgtctgccgggtgaccgctgtaaagctgatgtttcggtttccatacccgagtgacagcagcgctttgatgaaacggaaacattgaatcaccccattctcctgctcatcaagcatttcctgactgacggatgcgggtgcgaaacgatccggcgcaatccataagaaatggcggatatcttgatacccggctgtcaattcacgtaatgtttgctcgcttgaatgatccggcgtctccgccagatgggcgcggggccacatttttgccgcggcctttatggtatttcccggctttccgatgatcagcaattgttcctgatcaaccgctcgattttcttccagggaaaagaaagttttgtcccaaacaggggctagcatcgccgtctgaacttcctgccgtttgctttcggtttggtttgtctgccggacagcccggcaggagaaccctgtcaatctcatacaaacagcgccgttttcatcacataaatcaatatccagcgtcagcgctccgttatctgaccgatcgctctgtttgcggacaagcgcccacatcgttttctgagtcggctgaaatatttctgcctgccgcagggaaaacggcagcatcggagtgtctccggcagtatctgaaccggcccccagtgacgcctgaaacgcggcatccagaaggctcggatggatgacaaactgatcggcggtactgtctgccgtttccggcagcgacagccgggctgcagcccccctctctccggtcatcagctgatcaatgccttgatggctcggcccgtagatcatacccgcatgccggaaaacctgataaacctcatcagacgtcataaccgattggctgcagccggacagccagccctctaaatgaacagacggagccgctgctatctctcccgataccgcggtgcctttactgtataaaatccgttctccccaggttcttccgatagactgtaaatcgtaaattcaatgtcttcattttccttaagaataaggctgatatggacttctacatccgtccctttatgaatgacaggcctcatccatatgatatctttcaaatacattcctttacgtccgtccggcacagcgtatgcggcacgctcaacggccgctctggccatttcgatcacggcggctcccgggagcaccttctgtccattgactgagtgatcagtgaaaaagaattcccgtccggtaaaaacagaggtgaatttcagctcccaaagatcggatgtgttttcatggagcagcggatggatcaccgttttgccgtcatccctttttgaaaccgcctcggcttcatcttgaatccagcatctgacttttgcaaacggataggcgggaagactgattctccggggtttttgtcccgaatataacaagttccagtccacatcgactccctgcacccacattttcagcaaatgaccgtactttctctttttcagccatttaaccatggcttcctgcagatcttcatcagattcaaacacagccactgtctcatgatttcgcttcgcccgtcccctgtaaagatgcggtgcgttttcattttccaagtacgatctgagcttgtcctccagctccttaagggagcccgcaataagagccagccgctcatccatcgcttcccgccccgcttgtaaagtgtacgcgacatcaaataagtccggcttatcaatatgcttcttttgaagaaaagcaagaaggcgctccgcatattctgtcagacgctccccattttttgcagacagcagaatgaccgccggctcttggctgctgattgcttgtttgacaggagcctcatattcttcaataatgatatgcgcgttagaaccgcccgcaccaaagctgctgatccccgccctgagcggctgttcttctccgtctgctgaaatccgtttccaatctgttaattcacggcagacggaaaacggcccttcatcaaattggatattcggatttaaaacatctgcatgcaaggatggggcgatttgtctgtgcttcatctgcagcagcacttttgtgacagcggcgatgcctgctgccgattccccatgtccgatatttgatttgacagacccgacaagacatgtttcagaaacatcaccgaatgcctcggttaaagcccggatttcaatcggatcgcctaatttcgtccccgtcccgtgcgcttccacatagctgatctggcccggagatacccccgcttcctgtaaagcttgagaaatgacttcgctttgcgccttggggttcggtacggtgtaaccgctcgctctcccgccgtgattaatggcagctcctttaatgacgccgtaaatccgatctccgtcttgtacggcgtcttctaaacgtttaagaagcagcaccccgaccccttctgccggaatatagccgtcacccccggcgccgaaactcccgcagtgtcctttagatgagatgaactgcccctggctcagcatgaagtacttgttaggatgaacggtgagattcactccgccggcaagcgccgcgcgaatccgatgatcccgcagatcccggcacgccatgtacaatgaagtcagcgaacccgaacacatcgtatcgaccgaaatgctcggcccttgaaagtcacaaaaataggagacacggttagcaatggatgaaatcccgccggggagcccgatatgccgtcctttcactcccgcttcagccgcgaatagcgggtattcctgatacatgacaccggcatacacgcctacctgacggcccagttcaggtgatgtcctcgtatatcccgcatcctccatggccatccaagcatgcattaaaaacagccgctcctggggatcaaggtgttccgcttcccggggggaaatcttaaaaaactcaggatcaaaatcggcgatcccgtcaatgaatccgccccatttgctgtagatcgctcccggcgccgtacggtcctcggaaaagtaatgttcccatttccagcggtctttcggaatttcggtaatacaatcctttccttgtttgagattatcccaaaacgcatcgatatcatcggcctgcggatacttgccggaaatcccgacaacggcaatatccagcggttttcctttcgttttctgacggctttgattcccggacggggcaaaagacgcattttcaagccgatttggctgaaagacttctttcacagacgcatttttcaattccgccagctgttccccggtatgactgaggactgcggcatcaaatgagagaaacccgtcttttttatgtttgattgtattcaccacatagacggtatcagacatgacaggtccgtaaagcgtcagcctctcaatcatgagcgggacgtgaatccgctttttcagctgcaattcttcttcaccgagcgacatataacatgaattcaatataagcgggtcaaatgcaaagtgatgcagatcgcctttttctttttttcctgataagtccagctgcaataaaaaggaactctcactcattttgtatcccgccgttaccgttttcagcatcgggcctatcgtgaagtcggcaaccgaatcgtacagacgggaaatgacatccggccccaccttttgtgcatgcgactttatttgttcaacgtcatatgatttttttatgggtgcctctgtatatctgcttatttctccttcggcacatgtctttcggctttctttaccggagacagtccagcttgcggtaaagcgttcggcactcttttctgccgcaaatgaaatgtcaatctgtgcggcctctcccggctccagcgtgacgggcccgcccgtaaagcggatatctttcagctcggcgggatacgtgccggaacgagatgctccggatgcttcaagcaccagacacggatacactacacccatcagtgccggtttgccgaaaaccagatgatcctgaaggaatgcttcatgttcatagaaagtaaatgtctgactgcctgattgcgtttcagagaccggtgctgcatccgcgacaaggccggaagattcatctgttccttttgtttttatgtcttcaagcagttcggatatgctgctgcactcaaataaaagagtcggattcagacgcagatcaaacgccccttcgatgtctttaataatggccagaagctgtgacgattcaagacctaattcaaaaaacacggtgtgcgcatcatttcttgtgacaggacggcctacgtatgtcgagaaaatgcggtataaggtttcctccatctgctgaacgcctggtatcagctgctgatctgtccgcacctttttggctgtcaggccgagcagtgaagcaatatgcgcaccgctgaggttgtaaaagtcaatatccattttcaccatttcagaaggcgtgccggactttttcgaaatcaccgtgtaacagcgctccgtaacagtctcagcggcaataaacgactcataataaatcggtaaaaataactcggcgcctgcagctgtctgcaatacgccggaggccatggcggcaccgtccatcagcgcgggatgaaagagcgcgccggggagattttcccggcatgaatcagactgccgaatatcaaggaaacattcctcttcataagcatagatctctccctccggcttcatcagcccgtcatgcgacagtccgcggcttctcgcgtcttcgtaaaccgcatgcaaggagactgatggaagtgcggcttgttgttttttctcccctgcgtcaagacgcctgtctgatgagaagactccttcatgcatctccgcggataagaaaaccgtcccggaatccgccccgcaaatcgaggcagtccagaactccttttctttactgaatatgacactcacatcaagccgctctgaccgcttcactgataaaggatgataaatggtcacccgtttcagacagatggaacggaatgaaagatcaaggctttgctttgccagctgatacagcatatcaatataggccagaccgggcatgacagattctccgtgaacaagatggtttttcataatgggatgttctgccgtcaggcgcagattcactgtttttttcatggttagtccccttttaaaaacgtcacgttgtcacctgccaaaacgagtctgcaggtgcagtgcttgtctctgcttttttctcatatttctttaaaagatccgcaatgtccgttttttcattacttgttttttccggttcactttccgtgctgttccagccgcccaaaagcgggtagtgtttttttctgaattccggcggctgaggcgaccggtgatgttcccgctgccttgcacctctgtattcttcaacgaggatatgagcatttgtcccgccgtcaggaaatgaactctgagctgcgacgcggggtttcttctctgaatgccaatcaacgggttcacgattaaaatgaatacgcgacgcttcaaagtcataatgttcaaatggctcacgcgctgataagaaaggcggaatccgcttatgatagacgctcagcacacatcggatgaagcccgcaagacctgaagacagaagcaaatgccctacattcggtttcactgatccgatccggcagggcagaagcgttttccggttcagctgatagacatctgagagcgccttgatttccaccgaatcaacgattggggaaccgcctccgttcacttctatatatccgatgtcttcgggcgacttttccgccatattaagcgcagtttgaatgacgtctctctgcgcccttatattcggtgaaccgggaccgagcgtccggccgtcattgtttaccgagacggcttttatgacgccgtaaatacggtctccgtcccgcaccgcatcgctcaatcgcttgataaaaaccgcccccgctccttctccgagcacttctcccgctgattcacggtcgaatatatgaaacacaccgttctcattcaaaatatggcgcgctccgaataaccggtgcgcggatggagataagagcagactcaccgaaccgactaaggccgcgtcaatccttccggccaaaagggcgtcttttgcaaaggacagcccgatcagccctgaggaacatgctgtatccacgacaaggctcggccctgtgacattcaaaaatcgtgaaatgttggccgccaaatagttttgccccgcccccaaaatcggattaggcgcctgcaggatatgttccataccggctgaaggctgcgccctgccgccgatgtatacgccgactttccggcccgacaaatccttttgtccgtacccggcatcataaacggaatgaaccgcttcttctaatatgatccgcgcctgcgggtccataattgccgcgtctttttcagagatgccgaaaaagcccgcatcaaacatgtcgatatcatcaatccaccccgcataatcctttgcatgtgctgttgcatgccagcgcgatgcggggacaggccggatggcggtgttccctttcatcagcagctcccaaaaagcatccgttccgcccgcccccggaaaacggcaggacatgccgacgacggcaatatcgtcttcggtatccgctttcggcttcatggatgttctctcttcagcggcggcggttacatcaggctggacgtccatgtcttgaacgaaaccattttcttttgtcataaaatcggtttcatgatgcgctgcgaaatagtcaaccatttctgtaatcgtttgatattgaagcattaaggacggtgttaactttatgctgatccgtttttgcaatgattgaaccaattccgcaaagagtattgagtcaatcccgtattcatcaaacggcatatcatcttttatctgctcatccgtcattttcagttcttcgctgaaaacggtgcgcacccattgacgaatcatatccttcaccttttggtcaccggcactgctttttttcatgggagcttcagttttcttcaccttcagaagatcaccaaaatcagccttactgtcttcgggaacacaaggaattccgcagctttgtccgtttaatatgatgtaatctaaaaacttcagtccgtcttcggcagacagcctggaaagtcctgatttttgataagcaggtgtttccggcaggccttcagccatgccggtttctttccagacgggccattgaacggctttaacaaacacgtttcctttacctgcctgatgatttgcaaaagagtccataaatgaattagccatcgcgtagtcactttgccccgcagcaagcgaagggatcagaccagaaacggatgagaacaaaataaaaaacgacagcggctcattctgaacggcttcatagagaccgccaagccctgttactttcggcgtgcaaacgctttcgatctcagtttcggttttgttataaaaagcggggtgttctcccattgcacccgcgcaatgaaaaacgccggtaatcggtcccaacgtgccgcggatgctgtccgtcatgttccggagccccttttgatccgtaaaggaaacgctgtaataacggatctccgcgccccgctcggctaacctctgcatccgctcggctttttccgggagaatgccgtcctttttcatgtctgcccactctgaggaatcgggaagcggctcccgccccatgatgaccagtttcctgcatccgcgtgaaacggcatgatccgccgcaattgcgccgatcccgcgcgatccgcccgttattaacagcacatcatcagacgaataggaaagctcaggcgccgccgaaacatgcataccctgcttcagaaacggcacataacggcgattcagcctgtagcagcattcactgccgcttttggcccgcggctgtaaaaattcagtctcaatctgtctgcttaattcttctgtatgctcaatcgcacaatcgctatctattgtaaaagaatgaatgttggcatactcagcgcccagcatccggtacagccccgccgttttcgccccctgcatcagaggtttactttccttgaaaggctggaggcggtgtgtcacttggctgaacacagcgccgctatgacggaatgattccagagcctgctgtaaaaaggcaagctttccgtattctatctcttcccgccgttcatattccgcatcatatgcggttatgtcgacgaccccgagtatctgtttgttttgaagagactcccgcactctgccgtaaaggtttcgccccgatgcggcagcgtaataatcggcgccgtcttttgcctgatggatgaaacagatcgtttcaatatggtcgtttcctttaaatagagcatcggccaatcggctcgtcttatcagttgcaagtatcattactgttcctgataatgcttcagactccgccggatcttgctgcttccagtctttttgaagaatgatcttttggttttccgccggttcgtctgtctgtttccggatatccgcaggcacaggcacccaataccgctccttcgcgaacggatatacaggaaggctgacccgtttcggcttctctccttcgtataacaggctccagtcaacggcggctccttttgcccactccgtgagcaatctggaatattgcttgtttttcaaaagttcggccattccccttgatgaaatatcatcttgagcacgtccgcggaaacacccttcaatttccgttttccgttcaagcacatccttcagtttcgcttgcaggccgcaaacggatgtaacgatcaatgccagccgttcaggcatcgcttctctgccagcttgaagcgtgtaggccaggtctttaaggttgacttctttttcccgtaaaaagcgggcataccgtttgacatattccaatagccgttcttcattttttgccgaaagcagaaacagaaccggctcgtcttcccgtatattcaccgatttcttttcagcctgcggcggcagatattcttctatgacaaaatgggcattgctcccgctggcgccaaaagaacttaaacccgctcttctcggctggtcaggatgtgacggccgttcccattcttccagccggtccgccacataaaacggcgtatccggaaatggaatatggggattcagcgtgtccgcgtgcaatgacggaaagatttctccatgcttcagctgcaaaagcacctttgttaatccggcgattccggcggctccttctaaatggccgatatttgatttggcagagccgatggcgcaaaaccgcttcttgtttgtccatttgcggaaagcgcggctcagcccttcaatttcaatcggatcacccagagacgtacccgttccgtgagcttcaatataactcaatgtctccggatcaatgccggcactctgaaaggaatctgtaatgacttccgcctgtgatgccggatcaggcacggtcaaaccggatgtttttccgacatggtttaaagcggagccttttatgacgccatatatcggacagcccatcttttccgcttcttgaacggttgtcagcaacaccgcgccgacgccttctcccggcacatagccgtcaccgccgtcggcgaagcttttgcagacgccttctgaagacagaaatccggcattcgccaaaaacgcatatttatgcggatgtgtgaccgcattaacaccgccggcaatggcgaattcgcactcccccttttaatgctttcacatgccaaatgtatggatgtgagcgaagaagagcacatcgtatcaacagccattgacggccctgtaaagttcaggcagtgagacacgatattcggaacagaggcaggcgtcacgcccatagacagcagtgtgccccgctgtgtgatttcagcgccgaacagctcataatggctccaaaacacacctgcgaataccccgacgcgttttcttttttgtgaagatggcccgcgcgccgttctgtcctgataaaaaccggcatcttcacaagcttcccaagccgtctctaaaaacagccgcgcctgcgggtccatcatttcagcctggcgcggagtcagattgaaaaacagcggatcaaagctgtctatgcgatctaaaaatcctccgtaacggtagaactgatctgcttcatatgagaaaggataacctttccatctgtctttcggcattgttgtgatgcagtctttacctgagcgcagattttggtaaaattcatcgatgcttcccgactgcggatatcttcccgccaatccgattaccgcaatatcgtgctcttctgtgtgtctctcttgttttcggcttcttctcttgacagctgcatgggataatgaagagcggttcttgtctgccatcggaaccaatcgggccatgctttcagttacagcaggctccttcccgtataaaataacggattgcagcttgccgagacgcagcatatattcaagtgaagccatcccttccccggccggaagcgggctggtgccggttgcatcattcatgatctctttcatcaagctgtcaacctgcatgccgccatcttcccaaagcggccagttgatcgtcatagaagcccctgtccgttcgcctttttccgctttgcaatcgcgatatttcatatattcatccataaaagcgttcgctgcggcataatctgtctggcccgcatttccggtcagcgccgagaatgaggaaaatgcggcgaaaaattcaagcggttcatgccgtgaagcttcgtccgcatgaatcaggccgctgattttcggcaggaacacccgcttcaagtcagaactgtctttttggatgataaattgatcttttaaaacaccggcgcaatgaaaaatgcccgtcagccggccgaaagtttctgtaatctgagcaaatgcccgctctgtttcggctttgctgccgatgtccgcttgaacataaagaacttctgctcccaatgctttcagtctgctgatcttctcagactgttccggcgaacggccgatgagtgcgagcttcaccttttctttttctgcaaggtgacgggcaagcagaaatccaagaccgccgaggcctcctgtaatgacatatacgccgttttgtttccaaggagactgtgtctgtccgtccggtttctcaatacgttcgaacaatctgatctgccgcatatcgtctttataccgaatgtctgtgcagcctgcacgagagcagtctgcttctgttctaatgattgcggccgtctcacttagcaatctctcattcttgtcacaaaaggtgatcacctgagtgtgaagagccggattttccagatgggccgttttcagcatagccccgagagcggaagacaatgccgctccattctcaacggcgcatacaagctgaatcaatgtatgttctttcggatggtctgtcagttcccgtttgagcatacaaaatatgcgctcggcatctgctccaaactgctcatctgcaacctcatgctcccttttcagttctatcacttccgcttccgggcaatatgtgccgagttcaccggtgagacgggctcctgcatcggcagcgataatgagatgacgggtgtgtttttgcccgttctgcaccgccgtttccagcggatgatctttccaggcgggttcaaaaaacagaacctcatcagcaatgtcagcgtctgatgtatgccgttcttcggccgaatctttcagcacacagcccgcttcattgataaggtaatccgcaaggcggcggacagatgaatattcaaatagcagtgtcggataaaactgctgctgaaaagtctgctctaatatctttacaagcttcagcaaatgcgccgagtcaagccccatatcataaaagcctttccgcacatcaatagcctgtgccggacgattgatcagcctggcgatttccgactttatgtaagtcaccatgttttgttccggcgtttgctgttcagacacgtcttctgcggccacaggactttcgggctctccacggccgcttctgttctgctgaggcggcttctctttgtctatcagatgggtaatcatattcgcttgtctgaccctttttactgtcagtttctcacattcggccaatacgttccccgccctgtcgtaaatcgtgaagtcggccgaataaaaatcaggttcgctatctgatgcgccgctttcagtgcggctgtttttcgcagaataagtgtaaatcgttttcggaaacggctgatatatgcaaaaacgattaatcataaaaggaatataaggtgtgtcattctgcttttgggccgacaatgcaaaggaagagccggcaagggtggacgcatctaaaaaagccggatgcgccttaaatttctcccggaatccttcagccaaatcactcagagtgagctccattaattcttctttatcctgaagctgataaacagccccttcatttttcataaactcgccatgctcaatatggcttcttcttgcaattccgtaaatgtcatgcatgtcccattttcggcttgcgtttttcatgaatgcttcaatattcagttcttttgcccggggcgtgtctttttgcaaataaagctgacattccatattctcatcccgttttccgccaagcggtgtgccgttttttgctttttcgcttgtgatctcaactttccagctgtcactcgccggcgtaaaggtgacatacaggtgtttatcaaactcttcagatgttacaacaggctgcttaaaaataatctgtcttaattctataggcctttcaccgagatacccggcggcgagccgatacagcatatctattaaagtcacgcccgggaggacgcggatttgatgaacgcgatgatcccggacgatataattcgaatggctgattttctgcaggaacgttttgacttgatcggtggcaactgccaatctatcacacctcgcttatttcaaacattgcttctgtgcccgcctcattttcttccgcttcggacaactgtgctttttcaggccaataccgctgttttcggtatactgtctgaccgcctttcggttccatggtcgcttttcgttctttcggaattccttcgttgctgacaatgatatgggcgttattcccgcccaaaccgaacgcgctgaccccggccctgagtatctctttttttccgtcccaccgcttcagctcaagcacaggataaagcggcgaatcatgaaattgaaagcgggggttcggtttatggcaatgcaaagtcggcgggagttcttcattggcaatcgccagcaaaactttgatgattcccgccgcgcccgccgcactcagcaagtggccgatattgcttttgacgctccctacaccgcaaaattgtttttcatcggaataagcagacaagacattggttaatccttttaattcaatcgggtcgccgatcaaagtaccggttccgtgagtctctacgtatgtcatggtgtccggctcgatttccgctgattgaaccgcctgctcaatcaagtcctgctgcgcccggggattcggcgtcgtcacccccattgtgctgccgtcattatttatcgcagagccgtcaataacgccgtatattttatcttcgtcttctatcgctttttcgagcggcttcagcatcagcacaccgcagccctctccgattcctgttccgtccgcatcggcatcgaaagattttgaacggccatttggcgataagattctcgccgcgctcattgtgagaaaaggtttttcatcaagcaaaatgtcaaccccgcccgcaaaggccgcctccgcttctccattttgaatagcctgcacagccaaatgaattgccgtaagcgaactggagcaggccgtatccacgaccaggttgggccctgtaaagttataaatgtgcgccatatgtgcggtaataaaattttgccccgcgccaataatcgcgtctttttgcaaatattgaaatttctgatgaaacgcacctgcccttgcaccggcaaaaacgccgatacggcggccccagagatcctctttttgataacccgcatcggccaaagcttccgcgctcacttcgagccactgcctttgcagcgggtctatcatcggtgccagcgtttctgaaatattaaaatactccgggtcaaaatgatcaatatcgtgaataaaaccgccccatttactgatgctttttccttcttgatattcacccggctgatagtgttctccggcgttccatctgtccggcggaacttcagtgacggcatccgttccgctgcggagattcttccaaaattcttttatatcccccgctttcggaaaatgacaggccatgccgatgatcgcaacctttccccgtttcccgggcttatctgccgtttttttgctctgtttcggcgtcttctgcaaagggatcttctccgcgggaaccgctgcatctgccgaaaaagcttccggacaatgtgcggctaaataatccgcgagctgttctatggtagggtgttccagaaggacagtcggatcaattgaaacggacggcagtttttgatcgatctttgtcagcacctgcgccagaaagatagaatccattccgtattcctgaaaaggcacatcgatatccatatgcgtttcatcgatactcagctcttttgccaaaagcgacttcagccaagattgaatatcagtccggttatggacccgtttttttgtttcaggaggtttggaagctgttctcattcctttatgggcggctggcttggcgttttcaagcgctttgatgtcccaatcatgtttcacttgtgccggcagcacgacggttccgggtctttctcttaaaatgtaatcaagcatcttgagaccttccgcgtcagagtgacgcagcaatcccgtttgctgatacatcccgctttttgtatccctgctcatgcccgtctcatcccatgccggccattgtatgctcatgatgccgctctcattgttttctgcaaaatagtccatataagaattagccatcgcataatcgctctgtcccgccgcaagaatcgggacggctgccgagacagatgaaaacaggacgaaaaatgccggcgcatcatcctttacactctcatacagactgtgaaggccgtctgctttcggggcgagcacccgcgcgatactgtctttggatttgcggagaaaagcagggttttcacggtccgcaattcccgcgcaatgcagaatgcctccgacaggtccgagcgttgtggttacctcttttataagccgtccgacagcctgcttatccgtcagatcaactgtagagacgcacacttttacgccttgtgattccagctttcggataagctgtattttttccgaaacgacagggtctgtttgctcaagatcccactcggttttcggcggcagctcctttctgcctgtcagaagcagtttcttcacaccgtatgcggaaacgaaatgcttggcgcataaagcgccgagtccgcgcgttcctccggttatcatcaggacggcgtcttttggaaacacagtccggtctgtttgcacggcttctggttcaatctgatcagtctgccgaagaacatagctgaagcgcatgccgtccctgtagcaaacagcagattccgttaagtctgattcaatttcttgtttaataaaagcggctgtctgctccagcggctcttcaggatcaatatcggcgtgacaggtgagaatatggctgtattcatgccgcagcatgcgataaagccccgctttttcaataccatgcatagcggccgccttatttttgaaggattcaaggccttttgtaagataaagcattttcatgttttcttgtccgcggccgtattcaatcagctgctgcagcgatgccacccagctgatgtcctgccgcttttgccgggaaccgcagccggtgaagtcaataaacccgaaatagatggccgcattcggatcctgtaagaaagagatgagctgattttcctgcacaatgtcagcatcatttagctgttttttcacctcggcggcaaggtcttttgtatcctcggagacgatgagcgctattttgctgaatggctcggatgaagacactgcctcgcaaggctcccatgttttctgcaatactactgttttttgattcgaaagcggcagctgctcccgtttcggcacccaatagcggtcggctctgaacggataggagggcaggctgatgcggcgcggcttactgtccgtatacagctgctcccaatctgtgtcaaatccgtttacccagagccgcagcactttcttgtatttctttttctcaatccaggcgctgacgaggtcagcagcgtcttcatcgtctgagaacatggaggtcgtgttattctcgcgttttttgcgcccgctgatgatatcttcgctgttttttcccatcagaaacgcgttcagtttttcagtcagttcctctgcggagcctgcaatgattcccagcctcgcttccattgcgtcccgtccggtctgcagtgtgtatgcaacatctgcaagatcgatatggcgggatgatccgttttggataaaatcccgaaggagacgcgctctttctttcagccgctcttcatttttagccgacaaaacaaaaagagatgacgctttctcacgggtttccggctgttccgtttcacttttgcccatgtattcttcaataacgatatgcgcattgacgcctccgaaaccgaatgagcttacacccgcccggcggggcaggacccggccgttttcatcacgcagcgcttcccactcctttgtttctgtcacaatgtaaaacgggctgtccttcaatttgatatggggattgatgttctcgcaatgcagacttttggcgagcgtccgatgtttcagctgcatcaatactttgataacgcccgcaatgcctgctgcgagctccaaatgtccgatatttgtcttcactgagcctatcccgcaatatccgcccggagccccgtctgtttggaaagcttttttcaatgcattgatttcaatcggatctccgagcgccgtacctgttccgtgcgcttctatataagtaatcgttgacgggtgaataccggctttttgataagcgcttttcagcacatccgtctgagcctgcggattcggcgcggtaagtgacgctgagcgtccgccgtgattttccgctgtaccgcggatgaggccgtagatgtgatccctgtcatgctcagcctctgaaagctttttcaagacaatcatgccggcaccctctcctctgacataaccgtcagcctgatcagaaaatgttttgcagcgtccgtcttcactgagcatgcctgctttttgaaaaccgatatggccttcaggcgtgacgatcgtgttgacgccccctgcgaccgccatatcacaatctcccgtttcaatggcttttaccgcgcggtgaatggcgactaaagagcttgaacaagcggtttctaccggctcgctcggcccgtggatatcaagaaaataactcatccggttcggtccgacggacggcacgattccggtcatcgtatacccctcgacaggaagacccgccttattgattaaggtttgatatccgcttcccaatgtgccggtgaaaatgccggtttttgttccggcaatccgttttgctgagtaccccgcgtcttcaatggctttccacacatacatcattaatagacgctgctgaggatccatcatttcagcttctttcggagatatcccgaaaaacagcgggtcaaacccggcgattccatctataaaaccgccccatttaattgacgttttatttgcagccgctgccggatcgccgtaatattcgcgccaatcccagcgatcccggggaatttctgtgatgcaatgctctccttttgataaacgtgtccagaattcatctatgtctttcgcttgcggaaaaataccgctgattccgataatggctatcggttcggttttttcttctgattttccttttacggatacgggcgtttcccgtttgacatgaacggccgccggagtttcagcttttctttttccggcttttggagcggttttaaaacgctctctttctaagccgctgaatgcttctttccattcagatatcaaatggccgctcagtttgcgcaatgtcggaaattcaaagaagatagtcgggctgagctcaagctgataagaccgatttaatagatttgtaaattcagtgaagatgatcgaatcaaatccgtattccgtcagttcgctgtcagcctcaatatctttcatgcttacctttaaaagatctgatacatgcctctttagtttctcttgaacccgatctttcagatctgttgcatctgtctctgccggagcttgtccggcggcgctttgttcttcgcccagatcgaaaatatggctgcgaatccgtttctcgtcgccttctgccaccatgacctggtgtgctccggaggcaaaagcggcataaagcgcctggatgcctgatgccgatcgcatggctttcattccggtctgttcatacatcagccgttcggtctctttgtccacacgcataccgccttcttcccaaagcggccagttgacggacagggtctgcccgctccgcttgttgtcccgcacgagacgatttcggcgggctgcataaacatccataaatgcgttggctgccgcataaccggcctgtcccggatttcccatgcctcccgccaaggaagaaaacagaatgaaaaagtccagccgcacatctttcgctgcttcatcaagattgataagccctttcaccttcggcgccatgacggtcttccgttcgttttctgtctggttcagaatgtagttgtcggcgatcacgccggcgccgtgaatgatcccgtcgagtgttccgtgctcctcctgtatgccgcggacgagggcgatgaccgccgccctgtctgtcacgtcaaccggtttatacagtacgcgggcacccgtcgcttccaagcaccgtaagcgggcggagcggtctttatcaagcgcttccgcccttcccgttaatatgaggacggcgtttttgacgcgggaggctatttcttcagcgaaaatcagcccgatgccgcccgctcccccggtaaggaggtaaaccccttcgtctttccacggaacggcgccgctttgagaggccggcaggtgacgccagtttctgacgaaacgtttgccgccttcataacggatttccgcttgttcaggatgcgcccggttttctttcagcttggcaagaagcgctgatgctgactcgtccggatcggcttggatgacttggccgtacagcttcggatgttcaaggtgagccgttttcagaaaagcggccagccccgccaatacattgtcttcccccctgtcggggacaagaagctggatcagcgtttttcccttctgtttttctttgataagacgcttgacgatcgctgacagctccgccgcacaggcgtcataacggtcttcaatcggaccttcgccgtcagccgcacatacggcgccgcttatctcctcagcgttcattccgccatacagcgtcacgtatctgaaagactcttcttgtccgccgccttcatccggcggtgattcctgccactttggctgaagcaagagcggttttccctccgtttcctcttccagaaaacgggcggtgagccccgtcaatcggacacatacctcgccgttttcatcacacagctcaatatgataggcgccgtccgctgaggaaagcaccgcccacatcgtctcacggcatgcagaaaacacctgcatatcctggagggcaaacggcagaaacggccgtccggacgcggaaccgtctgagagcacgagaccgatagaagcctgaagggcggcgtccagcatgctcggatgcaggatgaacggctccttttcttcgcgggcggacggcggaagagtgagcttcgcgagcacttctccgcttcctgcatagacggcgtcaatcgcctgatgagacggtccgtaggtgatgccgagactgtcgaatgcttcatagcactcagcctttgacatgcgccggccgccgcagcgcgcctgaaccgcctccacatcgagtaccggagcacgctccgtctcttcgagcacggcctttccctggaaaaagacaagcggctcttccccttcggcatacgcttcaaaagcgatgtctccgttttcttccggctgaagctttacatgaagcgtcactccctcagaaagcaccgtcaccggacggagccaaacgatctgtttgagccggacacccgctttcccgcccggcaagtcttcagcggcaagcgtaacggcggcccgggccatttctaaagcagccgcgcccggaagcaccggttttccattgacgatgtgatcagcaaaaaacggttcatgccctgaaaaaacagaagtaaagcgctgggcggtaaaggtcgatgtattcgcatggagcagcgggtgaagcttttcacgttcagctgaattccggctttcaagctctccctgaagacgatcggacgcccaatacgtctgccttgcaaacgggtagcccggcagattgccgattcgcggcaaaggtccgccataaagcaagtccccttcgatttcataaccttgacaataaaaatctgccagcacgcataacagttcctgatattttctttggtcagaatatgaggcgctgcacttgccgagcacttctattatgtgctcctgaatatgctgtcggcctgcaaagtgctgcggtacttttcccgaaaacacataaggatgatgttcattaagctttgcctgcttccatacatacactgcgtcatcagcatcttgaaccacgatggcggcgcgatggttaaagtgatgccgtccttttagcaacgtatagctgagctgggctagatcattttctttcagtccgccattttccgcccaagtgatcatatcttcgattttttcctgaagggcctcctttgtttttgcagacaaagtcagtaaataagcaggggcatcccgatgaggtgaagcgctgcgcttatagctttccataacgacatgggcgtttgttccgctcatcccgaatgcgctgactgcccccattcggtttttatccggcagagaaggccacggtttacccgttttattcacataaaaaggactcttctcccagttgatatagcggttttccccgctgcaatgcagactggcgggaatcatttcacgggagaatgcctgtaaaagactgatcaaactgacaatgcctgacgcggcaaacgtgtggccgatattggttttaattgatgtgagcgcgcaaaatgcttcttcgtttgtataggcagtaaatgcgtcataaagcgcgttaatttccaccggatcaccgagttttgtccccgtgccgtgtgtgacgatatattcgatatcttcagggttgatacggccccggtcataaacggaagtaagcagccgggtctgcgcgacgccgctcggagcggtaattccgtttgttttcccatcataattgatgccgctcgcccgaatcaccccgtaaatcggatcaccatcttcttccgcctctctcagcggcttcagaacaaccgccgcggcagcttccccgggaaccatgccgtcagcccttttatcaaacgcgaagcatttcccgttttccgacagcattccggctttatctatcgtttcaaaaaagtccggggtattcatgatattcaccccggccgcaacagctgttgtgcactctttattctgcaggcttaataccgcctgatggacagaaacgagccccgaagaacatgctgtatttatcgccatcacaggacctgataaattcaagtgataagccagccgcgccgccaaaataccgttatgatgagacgtgacattgcctttgtcctgtgttaaaaggtgataatctccttcttccgcacccacaaacataccgatcgtctgctgcctgatgtgactggcgccgtagccggcgtcctcaagggccctccacgcttcctgaagaagaagccgctgcttcggatccatcgtttcagcttccctcggcgatatttcaaaaaataaagggtcgaattcgtccgccccggtacagcgccgagtttccattttgaacttgtgaagcctttttttgcgaccggtgcgacaacgtccttttcctgaaacagaatgtcccacagctcgtccgccgtgcgcgcctgaggaaatcggccgctcatgccgataatggcaatggaatcagctgcctgactgccctcggttccggcgttcagcttatttcttcccctctgcttctttcgcttttccgtttctgccttttcaaagacagattgatctgcggattcagatttcttttcttcatagacatgctccatgacggacttgtgttccgtcagaaaatagcggacgaccttctccagtgtggaatgtccgaaaaacagggccggggtcacttcaattccgtagtgagcggacaaagaagaggcgaattccgccaaactgatagaatcaaagccgaaatcagccagattgtcagcatccgtcagtctgttcttgtctattttcaaaagccccgccgccagttccttcacatcccagcttacgcattcttccagtgtaaagcctttcatttcactccgccttcctgaaaacgggacgttcctgtttacagaacccgaattcggcctttcgccttgatctatctgcaggaagcgtttggccctcgacggaaaaccggccagcacgagatactggctggacggctggactaacaatgtttcaaaagcttcgagtccttcctctgtgtataaataacgctgtccgctggattttaaatacatatcggtgctttccgccgtgccgacatgcatccccccttctttccaaagcggccaattgatggcaagtgacttaccgcttctgagtccgaggctcacaagtttatcccgatgacggacaaaagccatttggaagcggttccccattgcgtagtcacaagaaccgaagtctcctaaaatcgctgaagaagaagagaaacaacagaagaagtcaagcggctcccgtgacagaacccgatctaacaccgcggtgccgtccgcttttggcgataagacttgctgaaaggtttgcagatctttctccagaatgctttcagtgccttgaagacctgcagcgtgaatgacaccgtgaatcggcccgcatcctttctctttcgcttcttgcaaacctttctccatctgagcctgatctgcggcatccgcctgcacgtaaaacaccttggcgcctgattcttccaatctctttatcttgttcagcaccgggccgcctgccgctgatctccccgtcaaaatgagcgtaaccggtcctttttcagcaaaatatccggcgaataataagcctaaacctccgcatccgccggtaatcaagtacgtttttccgctttttatcacacgcttctcaacatgggcaatatccgtctgcttcatttccatgacgtgacggatttccccactgtacatgacactgcggaacgactcgctgtgaagctcttcacatacgttacggatcagcttttcaaacggtcctttttgtccaaaataaaccgcggccgtatccgtctccggcaggatcagtttcagcgaccgttccagcccgatccatgactcggcgtaattgatatcggcatcggtcccgcactgagcggaaagaagaattcgcctcggtttagaacgtaaagaagccgctgcgcggatcacatgatacagaatggaatagtctttcacggccttttcatcttcaagcggccatccatacaaaacggcatccgccttgcctgcagccgtttcaatatgccgaaacgtttcttgatatgcttgtccgtcagtgattttaatttgataatgcgtgtttgaaagcttttgagtttcctcaccctgtgaaataaaaaacacgccggctcccggataaagggattgtaaagaccgataagcatgttttctggcagcttctcccgtaagaaaacagatgaccgttttcagctcttcatgaatggatttcttcagaggctgctgcgtccacctttcttcaaatatcatcatctcggagtgttcctcttgcccgtgatcctgctgagacggctgtctcattctcacccctttgatttctgcgcatacaatgccggtttcgtcacaaaattgaatgtcacagccggtttgattctttttattcatatacatccacatgccggatgagcacggacgcatgacgcgcagttcttcaaccgcttcaggcacgatatggactgacggctccgtttttgccaggacatgaaaagctgcgtccagaaattccggcggtagatgatatcccggattacggccgctttcatctgtaagagcaagcttcgcccaaaccgtattttctcccgtataaagcttttcaacggtgcggaactccttactgatcgttacacctgatgtgcctggtgtttcataatcgaatgacagcgggcggcagtctttttgtaaggaggcaatatcaagcatgcgggacggctgtatgttcccttgaccgatgattccataatgatgcagcttctcttcatcactgtatatttcataatggatgccttcctcgtcttcagacagaagggagagattgacgcccgcaccgtgatgtccgccggtaatcgggtcagtccatgccgctgttcggatccatatctctttttcttcagagctgtctgccgcatgatgataagccgcaagcgccatttctaaataaacggctgccgacagaacccgctcccctctcacatcgtggaaaacgtgttcccggcctgtaaaagatgtatgatagctttgctccgccaaggttgacgtattttcatgcaggaaaggatgcacatattcagttgttcctgtttttggttcttcccgcttcatccagtagctttcttttgcaaatggataagacggcagactgatacgatgcggcagcgcgcctttatataaagatgcccaatcgacggacgtcccgtgaacccaggcattcaaaagactgtcaaattgacgtttttccatccaatcaccgactgtgccttccgtcgctgtgacagcactatcactccggcccgtaaacaccccgcttacggaaccggcattattcagaaaagcagtcagcttctgttccaattcagaaacagagtccgctgtcatcgccagccgttcttccatcgggaccctgccgacttgaagggtaaatgccgcgtcaagcagatttacatctgtaattgttccgtttccggcggcatccgacagcaacagagcccgctcgcgcaagcggtctttatcttttgccgataaaacaaaaagcgccggacggccggagtccgccgaagtcatttcagccggttcatactcttctataagcaggtgggcatttgccccgcccgctccgaaagaagatgtacccgcgattctcggatattcccgtgttactccttcagattctatgaccggccgtctccattccgccgtttcctgctgcacgataaaaggagaagtttcaaaatcaatttccgggttcagctgctttgaatgcagcgacggcaccagatatccgtgtttcatctgaagaagaattttggtgacggcagcaatgcccgccgcactttccaggtgtccgatattggatttaacagaaccgatggaacaaaattgctttgcatccgtatagcggcggaaagccttggttaaccccgcgatttcaatcgggtctcccaaggaagtgccggtgccgtgggcttccagatagctgattgctctcgggtcaatccctgcccgctccattgcgtctgcgatcacttccccttgtgcattcgggttcggaacggtgaacccgttcgttttgccgccggcattcagagcgcttcctttaatgacaccgtatatatgatcatgatcttcaacagccttcttcaacggctttaacacgatacagccgacgccctctccgtcaacaaacccgtcagccttatcaccgaacgctttgcacgcgtttgacggcgacagcattctcatagaagaaagtccgatataatgaaccggatctgtaatcaggtttacgccgccggcaatcgcgcattcagatgcacctgttctgatgctttctgcggcgagatgaatggcggttaaggatgaggagcatgcggtatcgaccgcgatgctcggaccgtgaaaatcaaacacataggatacgcggttcgggataaagtggtagtgggcccctgtcggatagttgccattcatgacacctgcaaagacaccaacctttttaccggcgcatagtgaatcaggggtatatccggcatcctcaagggccgcataagcggtttccagaaacagtctctcctgcgggtccatgcgctccgcttctttcggggagattttaaaaaacagcggatcaaatttatcaatgtctgttaaaaagccgccccactttgtatacatccggccttccttaccttttgtctcatcatagtagtcccgccaatcccagcggtctttcggaatttcggtgattccgtgttcaccggtctttaaccgttcccagaactcattaacattttcagctccgggatacttcccggcaagaccgacaattgccacttcaaggtgttttgagggcggttcggaagcgggcggcgctttttcagaaaaagatgccgcttggcgcttcgtcaatccggcgctttttttgcggctttgctttttctgtagagtgtgcggcaccttttcggcttctttatttgtcttgaaaatcccagccatatcttcctgtcttgagctgacgagatattccgctaatccgccgattgtcggatactcgaagaacaatgtgctgctgatatcagggacgtcttcccgcacgcggttggtcagctgtacgattaagatggaatcgattccgtattcttcaaggggcgtatgggcttgaacgtcctcaatcggcatctttaagatgacgctgacgatctgtttcagatactctgtgcttttttcaagcaaagagccggatgataccgcttcagtatgagggagttcttctgaaaatcgcgcatgcagttcgcgctccttcgtttcagccaagtatgcggcaagctcttctatcgtccggtattcaaaaaacagcgtgctgctgatatcagggacgagatcccgcagctcattcgtcagctgaacgatcagaatagagtcaatgccgtattcatccagaggagccagcgggtttatctcttctgccggcatttttaatacttttgccgcagcccttatcagaaaagccgctgtcttttccgaaagcccctctcccgcttgtttgatggggagctgacgatcagaggatgttcgcggtacgtttgattggcgcttttgcgcggtgtaagcttccctgctctgcctgatgactccgttgcttttcgctgtgataatctgctgggtgtgcagacgttcgttttcagccggaaattgaatggaatgaaagccttcagccattaaaacggatttccatgtttccggataaagaccggggcaccccggaatccgcagcacctcatcttcgtacagccaccagccctctaataagccgaatgtaacatgtgtaaacggcgtatgcccgcccagttcattaacgagcagcaaaccgtcttttttcaatacggcttttgccgtccgtaaggttttccggatatttttggtagcatgcagcacgtttgcggcgatagcgatatcgtaggttctcagatgtaatccctggcccgccgcaggcttctccacattaaacagctgatacgtcaaaaacggattgtccgcgccgtattccttttcggcatgcattaaaaaagcttttgacaagtcggtataacagtattcctgaatatggttttgataggggcggagctttttaaacagtgtgctgctcgttccgccggtgcccgctccgatctccagcagacggatgtttgcctcaggattgtatttaattacattttccacataaatacacgcttcatttgccagcacatcgttgtaataatcagcgagaatgttatgcttatagattccttcaacaagctccattgaagaatcgggaaacatcacgtcagtggcttttattttgcctgttaaaatgtcaggcaaagcttgaatgacggtatccgccagcagagcctgcgctttcatatccggatctttcagccattcgtttttcttcttatgccactcttcccacaccgcggccgtttcaccgcttttaaaatcgctgtctaaaagacgtatgctttcttccagccagcgctcatataaaggcagacaggaagctgccggcgcttcgccggtcagacccattgaacgcagcgtcacccgcagcacttgcagcaaaagccgattcaattctttcatttgattgcttatttctgttcttaaggataactgtgtacggtctttttgtttgtctcccttacccaaaaccttatcctcctaagaaaattaaatttgctccgtcattttgacaggcaatcagatagtcacaaattcatgagggttcattccctcgatcggaatcggcttggtcagcttcatcagccccatgcgggagatcggctgcgtcagcagagtttccagcgcctgcatcccatccgcccggctgatcagtccgagaccgattgcactcagtctgtcaaactcttcagaaatgtgattgtcagcccgctcccaatacccccagttcatcactttgaccgggcatgacagccgcccggaaagctcatgggcaaatgcgtctttaaatgcgcaccccgccgcataatgactttgattcggattcttaatatatgaaataaccgaagagaaaaagagaataaagtccaaagactctttcgcaaatacttcggcaatgttgacggaaatatccactttcgccgcaaggccggcgtgaaactgtgattcttccatatcttttacgctttcattcgcaaataccatcgctgaatgaacgacgccgctgatggtgccgtatgtgtttttaatctgttcatagacgcgctgaagcgatggaagatcagaagcatctgcggctatatattcgggagccgagcctgatggccggtaccggtctattttttggcgtatccggctgtccagcggccgcctcccgatccagacgactcgggctttatacgtcgtcaccatataatctgtccaaacctcgccgatgcctcccgcaccgccgatgatgacatatacgcctccatatcggtaaggaacactttcagacggcccgctttggaccggaagcaattgaggccggtgccattcctgatgtctgcgcacccatgctttacccgtacggtcgcggggcaggctgaatatgtcttctgtggggaaatcccccccgtcttcaagatcgaccagacggatgtgccagctcggatgttcttttgcaagagacccgacgaaaccatgcacactggaatgagcgggacgcacctcatcatattgggtgataggctgtgcttggtgcgtaatcaccgtcatcccgagctgctcttttccatacccgagaccgataagagctttggccgctctgaaaatttgcagcaccccgcttttttgatcatggatgtaagaatcagccggctgaggggcaaaccagatcatatgctgaatctcaccgagacggcggagccgatcggatatcacttcaacggaagcactttggctgctatcaaatcgcacagctttaggaaacaatcgtaaaaccgcgtccgcctgcccgtctgtaccgcctatgatgacagcttttgcttcagaaatggggaagccggtttggttgtctatcggttccgcgtcccatacctgcatcagtttgacggctccggtaaggttacccggcagatcgtattgcttgtcatccgtttcagccggcgcactttcggccatccgggcagaaaatccttttattcttacacacacattgccgcgttcatcacatatatcaatgtccattcttcgcacggccggtgtttcatgcgtcacaaacacggccgcccacatgtttggactgcacggatgaaaaacggtcagttcatgcaattcaaaaggcattaacggctgctccggataacccgctttatcttcattcataacgccgatggccgcctgaaaagcggaatcaatcagactcggatggagcacaaactgttcggcctcatcacaaacggaagcagggagcaccaatttagccaaggctactttttccccgcaataaatgtgatcaattccttgatgtgaaggtccgtatacaatttccgcctttgcaaatgccgcatagcagtcttcttttgacagcacttttttgcggcagcgcgctttcagctgttcaatatgcaaaaccggcgcctcagacagcggctcaatcacagcactgccttcacaataaatgtctgaatcgttttcattgctgtacacttgaaatgaaatattgccgttatcctctaaggaaagacctgtcgtcatacgcagcggctcttttttatgaacggcctggcgtatccagctgatataccgcagcgaaatgccggttttagccgtgtattcagcggctaacggcgcggcagccagttcagccgcggctctcgccatttcaagataagccgccccggggagaacacgcttgtttcggacgatatgatcggctaagaagaattcatctccgttcagtaccgtgctgaatttttgttctaacaaatctgaagtattgcggtgaagcagcgggtgaagcctgctttctgtatttacggaagtgacgggatgatcgggctccggtatccaatagcggtcctttgcaaacgggtacgtcggcagactcatcctgcgcggtttctcctcctgatacagccgcgtccagtctatctcaaatccttttgaccacagctccgcaagttttttgtaagtgccgctgtccgtccattttcggatcagctcctccgtatcctgatcatcattcaggaaacccctgatttccgttccgctatcagaccgcccttgaaagcagccgtcaatctgccgttttcgttctgtaaattcggttaatttcctgatcaggtccgcttgatcgttcactaaaaaaacaagccgttcttccattgccagccgtcccgtttgcagcgtatacgccagtgaccgcagggaaaaaggttcatcagactgcttctctaagccggactgaccgaaaagaccggaaagaatattcttatgtttctcatcgtttgtcagacattctgctaaagtccggacggaagtatgctgtatgagatcagtcatgtctattgccagcccgtattgatccgtcagccgctcagaaaactgtgtcagctgcatgacatccaagccgaattccttccaatcctgttcaccatctaccgagccggcctctacatgcagaacttcggccagagcaccgcgcagcgcattttccagctgattttgcattgtatctattttgtcatgaagcggcccgcttccttcaagcgctttatctttgagaaacatcagcaggcgggcagcgtattccttcagccgctccggatttttcgctgatagaggcacgatatacggtctctcttgattctccgtaatgccggggtttttgggcctgtactcttctaaaatgagatgaacgtttgaacccgtcgccccgaatgaactgatgcctgcgcgtctcggacaggaatgttctctgccgttctctgtatacgccggctttttccatgactcggttttttgctgcacgtaaaatggcgagtcctctaaacggagatacggattaatcgtctctgagtgcaaagaagggacaagcgttttgtgaaacagctgcaaaaccgttttatgaagcccgctgattccggcggctgattccgcatgtccgatattcgatttaacggaaccgatcgcacaaaattgccgatcctccgtaaacgtgcggtaagctttaacaagaccttgtatttcaatcggatctcctaaagaagttccggttccatgcgcttccacataagaaatcgtcctgggatcgatccccgtcttttcaagacattcggctatcatatccccctgcgccacggggctcggcacggtaatcccgctgacggttcccacgtgattgacggcgctgccttttatcaccgcataaatatgatccttatcttcttcggctttgtgaagcggcttcagcagcacggccccgatgccgtcagctgagacatagcctgtgccgccttcgccgaacgtgcggcacagcccgtcactcgaatgcatatccatcaagccgtatgtgatatattttgtcgggtgcaatgataaattgacgcctccggcaagagctgcttcacattcaccgcgtctcagactttccgccgccatatggacggccgtcagagatgacgaacacaccgtgtcaaccgccatgctcggcccgtgaaaattgcagaaatatgaaacccggtttgcgatcggcgcatagttcaagggataaggaaagaccagccctttggccgcagcttcagcgccggcgagagaataatccatatgcatcaccccggcaaacacaccgacgttcattctcttattcggccctttcggctgaacgattgtttccggggtgtagcccgcatcctcaatcgtttcccagcatgtttctaaaaacaatcgttcttgcggatctttagcttctgcctcccgcggagaaatccggaaaaatttcgcatcaaaacaatccggatcgtctataaaaccgccccatttggaaatcggcttgccggacggcgatcgcaaatgctcatatttcctcgtatcccagcgggaacgaggcacttccgttacgctgttttctccattttttaaatttgtccagaattcacgaagatttttggcgccggggtaccgtcccgccatcccgacgatcgcaatatctccattctgcgttccggctgacgccgattttttcacacggatttgggtcgtcctctttttttccctgtgcaaaggttcagcatttgaatgcccgctttgagcatggccgaagccggctccgtaatgttcgcacaaatatcccgccaattccgtgattgtcgtgtattcaaataacagcgtcggcagaagctgcgttccgatttttcgttcaatttcctttaccatgtccaacagccccggagaatccagccccatttcatagtagccgatatccgggtcgatctctttcacaggtttgttcaatcgggcggcaagcaattcttttaaataaaggatgcactgttcagtaaggccggcggaagacgccgcagatcggggctcggaaggcgccggttccgcttgcagagccgggacggcattccgcccgtcaggttctttcttttgccgtttctgattaatcagttccgggtccctcacccgtttattggcgaagtttttcagttcgccgacttttctgccttcctcattgaaaaactccattgtcacgtaaacgagatctttcttacgggtgacggattctttttttatcttggtgatacatgtcgtctgcagcaattcggcgcaataaaacgattcataaaacagcggcagaaataattgcccctcctccctcgtcaaaggagcgagatatacattggagccgatgctgctcgcatctatcaatgcgggatgaaacatcgcctcttctgcatgttccagctgatccttttgcaccgacagatcaatataaatctctttttcagtctggtagacgcttccgcagcctttcatcattcctgaatgaaccagttcttgatccctgcattccgcgtaaatgtcctcaagcggtatttctgccgccgtttgttttacggcatccatccggacgctctcttggaagccggcgggcttgacggaatgcatttgcgccgcggcatatatctttgtctctgctgcttcgtcaccttgtttttgccctttcacctctaccttccattgcccttcgccgttctctgtacagtcaacggaaagcaggattgtttctccctgttcaggagctaaagggtgaaaaatcgataagtgcctgagttcaaggccggcatgaaaaaaaccgttttctctgaaagtctgatagatcaggtcaatataagccagacccggcagcagttcctttccataggctttatgatgtttcagaacgggatgctgattgttaataagaagctgctcttgcatatgaacttcctccatatcgacgttcaattttcagcgcaatcagtaagtcttcatttgtttccaaaacgtattcgggcgggactcatgtgcgttttcatgcaggttttcaactttgtccgaacggatgggccggcgttttaattcctgtctcggcaaaggctttctaaccggggtgtacgcctcctgctcccaggcttccactatgacatgggcattcgtccctccgtcagcgaagctgctgacggcggcaatccgcggtgaatccgtccattcacgcagcgcgtgcgaaaaataaaacggcgaggcggacagatcgtaatgcgtcatcggctctttgcccgaaaggaaaggcacacgcattcggcgcgaaagcataagcactgttttaatgaatccggcaatcccttcagcgcataacgggtgtccgatattcggcttcatcgaccccaattcgcaaggcgcgctgttttgcatacggtacaccgcttcaatcgccctcagttccaaaaggtctgttacttcagagcctgaaccgtttgcttcaatgtagctgatatcctccgcttttctgccgcttttggcaagcgccttggccatcacttctttctgcgcctgtatattcggtgtggcaggccccgcggttctgccgtcattgtttacggaaatgcctttaatgaccgcatgaatccggtccccgtcttttacagcctgggccgctgtttttaaatacaccattccgacgccttctcccaatacgatgccgccggtgcggcggtcaaaaatatgaaacgcaggctcttcgcttaacagattgcgaagttcgaacatccggtgggtttgaccggattccagcagactgactcccccgaccaccgctgagtcgatttcaccgcaagaaagcgcctgtatcgccatattcataccgacaagcgctgaagaacaggccgtatccaaaacaagactcggccccttcaaatcaaaaaactgagaaagattggccgccaagtaattcgggccggcggcgactatcggattttttgcatgcttcagacggttttcgtcaggcatactgccgccgcgtcctcctaaatagacaccggctgacctgcctttcatttcttgtaaagagtaaccgctgtctctgaacagatgaagcgcctcttctaatataagaaaggactggatatccattgccttgatgtcttcttcgggaataaggaaaaactccgggtcaaaatgcgttacattttttaaaaggcccgcataatccgccttctccgttttccagcgttctttcggcaccctttgaatagccgacgtcccttcagacagcagcttccaataagcttcaattgattcagctccaggaaaacggcaggacattccgacaacagcgatgtcttgcgccgctgcagcgccagaaggctgaatgacagcggctgctgtttgtttgggaacgtccgggattacaggctgaaccggttttgaaacggcatctttgatttccggatatgccgtttcaagccatccctccagcgcagcaaccgtagggtattcatacagcaccgccgggtcaaggtcagctttgatcctctttccgatcgctctggacacttgggcaagcatgatggaatcggctccgtaatcttgaaacggtgtatcagattcaaatcttgacggctccagtcttaattcccggcagcaaatgcccgtcagccactcctctacgctttctgtctcaccctgtacatgctgctttgtttcggtaaggccggttgaaagcatcagacggtcgggctcccatttttccgggtgaatgacggccggcataataacagatccgcaatcgcctgccataacggcatcaaacagactcagcccttctctgtcagtgatgctctttaaaccgcttttcagataggcccggctttttgattcgcccatacccgtttctttccagctcggccattggatgctcagcaccggaaaaccttttgcggccgcaaaataatccatataggcgttagccatggcataatcgctttgtcccgctcctaattccggcatcacgccggacactgaagaaaacagcgcaaaaaaccggagaggctccttgtgcagcgcttgatacaaaaggtccagcccgtctgttttaggttcaagcacgggcatcatctgttctctcgttttgcggataaaggctggatgatcgagatctacggctcccgctgcgtgtatcacgcctcctatcggccccatcttctctttcacccggctgacggcctgctcatattcagggccggaagatacagacagcacttccgttcggacacctttttgttcgagctctctgattcttctcactttatcggaaaacggggaattccgtttgatatgatcatcccactccgctttcggaggcattgtttcttttccggtaagcacgagtttcgtgactccgtaacgttcggcaaaatgccgggcgaataaatatccgagtccccgggtccctccggtgatccagagcacatggtctttcggaaatgaaaattctttttcagctaagctgtttgtttcctttaaccgcgcgtgatagcgcacatcgtttcggtaacacacttcgatgtctgcagaatcgcgaaaaaactcctctgcgatctggtttgccagctcgggatcttcggcagtccgttctgcatccatatgccgcgagcggatatccttatactcactttggagcatccggtacaatccggccttttttgcacctgaaagatttatcgtttcatttgcaaaaggttcaagcccctttgtcacacaaagcagctgaagctttcggccgcggtttctgttgtcaatgagacactgcagacgatgaatccagccgtcatcatgcttgatttccgtcccgcaccccgtcacatcaatcagaccgccaaaccgggccgcgtccccggatatttccggtgatgcagcgtcaatgatttcagactcggggaaataacgggacagctcaacggccaaatttcctgtctggtgatcagcagctattccgatgacgccccgcacttccttaaccggaacacggctgctttctgcccagcttttctgtaaaaagcggaattcacgaaatgtttcagaatgtgtttcagcatcacgaacattgtccggcgctgcatcgcccggccaataacgatcctttataaatggataaccaggaaggctgacgcgatgcggcaggctgccgttataaagctctgaccaatcaatcttcagcccttttacccaaagttccagaagctttgcgaatttttttcttttcatccatttacggacggcttcctgcatatcttcatccttaaaaacggctagaatatctttatactgtttgctttttcccctgaagcagccgtctgttccgccgtcaataaaacgctgcagtttttccgctaactgctctgtcgacgtcacgataaacgccgcacgttcttccatcgcttctcttccggtttgaagggtgtaagccgcatcccggaggctgcggtctgtgacgtcattttttctgatcgcttgaagaagctgctgcgcccgctgcttcaggctggcctcctgtttggcggataataaaatgactgcgggatcttcatctgtgaatggctcagaaatctccctatcaggttcaatatattcttctatcaatatgtgggcatttgccccgcccgcgccaaaagaagagattcccgcgattctcggaatctctttctgcgctccgttttcctcaatgaccggccgtttccagtctgccaattcacgctgcaccgcaaacggcgtccggtcaaatgcaatattcggattcaattttcggcaatgtaatgaaggggccagctttcgtttctgaaactggagcagcagttttgttacaccggcgatgcctgccgcggcttccaaatgcccgatattggatttaactgagctgatggcgcaaaagcctttatctgacgttttcatttgaaatgcgcgggtcaaaccgtcaatttcgatcggatctccgagttcagtgcccgtgccgtgggcttcgatacagctgatcatccgcggatgtattcctgatttttcaagcgcgccggaaatcacgtcagcctgggcgctcggactcggcactgtatacccgtttgttctgccgccgtgattgatatgagtgccgcgaatcaccccgtaaatatggtccttatcagccatcgcttttgacagcggctttaacagcacggccccgacgccttccccgggaacaaatccgtccccgccttcaccgaaacttttgcacgttccgtcttttgaaagcattcgataggcgctgagctccgcataagccgaaggatgcgtatacacattcacaccgccggcaatcgccatgtcacattcgccgcgaaggatgttttcacacgcttcatgaattgcagtcagcgaagacgagcacatcgtgtcgaccggcatgctcggccctttcagattaagaaaataggaaactctgttggccgctgaactgaacgacgttttcggctgcagggtgccgccgtttttccagtacattccgtacccgtttttcgtaatgcccgcaaaaacgccgacccggccgttatacagattctcaagctgttccttcgtataaccggcatcctccagcacctgccagcacatttcaataaagagacgctcctgcgggtccatattcaaagcatcacggggtgaaatttgaaaaaacagcggatcaaagaaagcggcatctttcagaaacccgccccgcttactgtaacttttccctgctttcacggccgcttcgggatcagggttgtagtatttctccttttcccagcgctcttcgggaatttccgtcacacagtcttttccggccgctaagttatcccagtactcttcaagtgtttcagcttgcggataacgtccgctgacgccgataatcgcaatcccttcttttgtctgtttctcattggaaaaagcaggccgtttctttcgcttgataaacgacggaagcaccggaaaatcttcatttgccaaaacctgttctgatatgcctgaacggtgctcatcatcatttgtccattttcggcattctttcggataatccgtgacaaagtgagctgccagggagcccagtgtcttatattcgtaaaaaaccgttttggaaaggtcaccgaaaagcagagacaattcgcggttcaatttcgtcacagtgacggagtcgattccgtaagtttccagcggctcttcagtatctatgttggaaacagcaatttttgcagtcaggccaaaaagcgttttgagctgaagaagcgtttgttcatacaaacgttcactgcggtgttcggtattggtttttccggaagcgcccgtcttgatgacaggctgcagcttcaaccccgacagggaagcccatatttttccttcttcatcacataaatcaatataaaagctccccgccttctcttgtatctcggcccataccttgtcaggacaagattcataaaacaaaagctcgtccaatgaaaccggggcgagcgttttatattctttgccgccaagcagcgcgcatgcctctgtcacactttgcatcacacagggagggaggccgaatcgggcggattctttttggtctgtcaacggaattgaaatgtctgccagcatccgtcctgctgaggcgtaaatacgctcaattcctttcatgtgctcactgtattgaacggtatcgttctgagtgatggcttcaatttgctgcttatccatcagggaaccgctgttttccttcaagcggctgatatccagcatgccgggcgcagcatcaactggctgaatcgtcccttggctgtacacatcataatgactggaatcagcagaaaatggattataaatctcaaaccttttggcttcaccctctgcgggtatcagcctgatctcgatatggaacggctcagcctcagtcaaaatgggctttgaccacacgatatgcgtcagccggacagccgcagtctcctttactgtcaaaacagccgcagctctcgccatttccaaaagaagttctccgggcataagctttttatgctgtaaagaaacatcagcgagaaaaaattcccggccgctgaaagctgccgagaatccctgtcccgtttcatcgaaaatatgctgctgagcaagcggatgaagggaatccgcttggcgaagtcccatccgcatatcataatcgcgcaaaatgccgatcgcatcctgttttgtcatttttttatttttgacgtcagaaaaaacccggtgcagaaactctttcatatggtttcctccattacgctaatccctgtaaaaaccgatcgttctttttacagcggcttctatgcttatttcgtttttctccaattcatcaagcaggcgctcataagtctcaagcggggacgtatcagtctcgtaagtctcccggtgccttatatgctgcgcactgggcggtatccagcaatgtgttttcgcaaaaggatagacgggcaggctgacttttttcggtctttcgtccggatataatttattccagtcgacatgtaaaccttgcacccataattttgcaagcattgcatactttcctgcttcaatccattgatctacggccccgctcatttctgcgttgtccgtcatctctgtaaacagctgtttcatcgctttgttccggcctgtaaagaaattctgccccgtctccttgccgctgaggaaatcattcagcgcgttcgtaagctcttcttttgtttcagcaatgacggcaaggcgctcttccatttcatcccggccaagctgaagcgtataagcgatatccgcaagagctccgtcagctgaatgtgacttttccaaatatctgcgcagctgttccgcacgttccttcagctgttccgccgtctttgccgagagaatgaataaggacggctgaagttcaccggccgtccattgtttctcttcaacaggagaaacatattcttcgagcacgacatgagcattgacaccgccaaatccgaacgagctgacacccgctctccgcggcagttcatttccgctatcatcagtcgccgctttccacggctgagtgtcgcggacgaaataaaacgggcttccgtctaggctgatatacggattaacggtttcacaatgcagacttttaacgagcgttttgtgctgcatctgcaaaataatttttaaaagcccggccatgccggcggcaagctctgtgtggccgatattcgttttgacggaaccgaggccgcaatgaggctgctcgggtgccgttactccggctttctgataaagcgctgcaaaagccgctttgagtccgttgatttctatcggatctccgagcgccgttcccgtgccgtgggcttcaatataactcactgtacgggggtcgatgttcgcttgctgatacgcttttatcatgacttctgtctgcgctttcggattcggcgatgtaagggaagccgcccttccgccatgattttccgccgttccgcggataacggcataaatacggtcgccgtcacgttccgcatcggataatgttttcaaaacaatcatgccggcaccttcagctctgacatacccgtccgcttgatcagaaaatgttttgcagcgcccgtcttcactgagcattcctgctttattaaagctgatatgcatatccggcgacacaatagcattgacgcctcctgcaatcgcgatgccgcagtctccggcctgaattgccctgaccgcacggtgaacagcgaccaatgagcttgaacaggcggtttcaatcggttcgctcggcccatgtatattcagaaaatagctcatgcggttcggaccgattgacggaaccgtcccggcggcggaagaaccctcaatctctatatggaactttgaagcttcctgggcgtaaccgctgtttgccgtgcctgcaaaaatgcctgtatttgtacctgacaggcttttggcagagcagccggcatcttcaatcgctttccatacatgcatcattaaaagtctttgctgaggatccatcatttcggcttcatgcggagaaataccgaaaaataatggatcaaattgagcggtttcatcaatgaagccgccccactttacattgctcgcatttttatctttctgcgggtctccgtaatactgtctccagtcccagcgccccggcggtatttcagaaatgcagtctttttctccggctaaattctcccaaaacatttccggattttcagccattggaaatgcacagctgattccgattatcgccacgggctcttcaggtgcagctgcggtttttgttttaggaaggcgggacggaatcgagaatggctccgtcttcatttttttacgctcaaccggtttctccgtttctgtttcttcctgtgagccgaatgtatccggatgttccgtcagcaagtattgggcaaaactaaagactgtcgggtattcaaaaaacacggccggcgtcagttcaagcccatacattttatttagttcatttgcaaactgcgtgaatgaaaccgaatcaaatccataatctctcatctctgattcagcatctatttcttcttctttcaccttcagaatgcctgatatcatatgtttgagttccgtttgtactttatttggcagatggacgcgggtcttccttgacacatgaatgctacgggacggttccggcgcttcaggcatcaggttttttcgaatccgtttctcatcgccctctgccaccatgacctggtgttctccggaggcaaaagcggcgtaaagcgcctggatgcctgaggccgatcgcatggctttcattccggtctgttcatacatcagccgttcggtctctttgtccacgcgcataccgccttcttcccaaagcggccagttgacggacagggtctgcccgctccgcttgttgtcccgcacgagacgatttcggcgggctgcataaacatccataaatgcgttggctgccgcataaccggcctgtcccggatttcccatgcctcccgccaaggaagaaaacagaatgaaaaagtccagccgcacatctttcgctgcttcatcaagattgataagccctttcaccttcggcgccatgacggtcttccgttcgttttctgtctggttcagaatgtagttgtcggcgatcacgccggcgccgtgaatgatcccgtcgagtgttccgtgctcctcctgtatgccgcggacgagggcgatgaccgccgccctgtctgtcacgtcaaccggtttatacagtacgcgggcacccgtcgcttccaagcaccgtaagcgggcggagcggtctttatcaagcgcttccgcccttcccgttaatatgaggacggcgtttttgacgcgggaggctatttcttcagcgaaaatcagcccgatgccgcccgctcccccggtaaggaggtaaaccccttcgtctttccacggaacggcgccgctttgagaggccggcaggtgacgccagtttctgacgaaacgtttgccgccttcataaaggatttccgcttgttcaggatgcgcccggttttctttcagcttggcaagaagcgctgatgctgactcgtccggatcggcttggatgacttggccgtacagcttcggatgttcaaggtgagccgttttcagaaaagcggccagccccgccaatacattgtcttcccccctgtcggggacaagaagctggatcagcgttttttccttctgtttttctttgataagacgcttgacgatcgctgacagctccgccgtgcaggcgtcataacggtcttcaattggaccttcgccgtcagccgcacatacggcgccgcttatgtcttcagcgttcattccgccatacagcgttacgtatctgaaagactcttcttgtccgccgccttcatccggcggtgattcctgccactttggctgaagcaagagcggttttccctccgtttcctcctccagaaaacgggcggtgagccccgtcaatcggacacatacctcgccgttttcatcacacagctcaatatgataggcgccgtccgctgaggaaagcatcgcccacatcgtctcccggcacgcagaaaacacctgcatatcccggagggcaaacggcagaaacggccgtccggacgcggaaccgtctgagagcacgagaccgatagaagcctgaagggcggcgtccagcatgctcggatgcaggatgaacggctccttttcttcgcgggcggacggcggaagagtgagcttcgcgagcacttctccgcttcctgcatagacggcgtcaatcgcctgatgagacggtccgtaggtgatgccgagactgtcgaatgcttcatagcactcagcctttgacatgcgccggccgccgcagcgcgcctgaaccgcctccacatcgagtaccggagcacgctccgtctcttcgagcacggcctttccctggaaaaagacaagcggctcttccccttcggcatacgcttcaaaagcgatgtctccgttttcttccggctgaagctttacatgaagcgtcacgccttcagaaagcgccgtcaccgggcgaagccaaacgatctgtttgagccggacacccgctttcccgcccggcaagtcctcagcggcaagcgtaacggcggcccgggccatttctaaagcagccgcgcccggaagcaccggttttccattgacgatgtgatcggcaaaaaacggttcacgccctgaaaaaacagaagtaaagcgctgggcggtaaagatcgatgtattcgcgtggagcagcgggtgaagtctggctgctttctcactttgcgctgagcctgttttgtcaagtgacacatcagcttttgtgacccaatatcggtctttggcaaaagggtaagccgggagactgatgcggcccgggttgcgctgataaagagctgaccaatcgacgtcaagtcctttaacccaaaggtcaagcagctttccgtatttcccttttttcagccaggcatttatggtaagcgccatatcttcatcagaagtgagcgaagccgccaatgaatgatgtttggctgtcctgccccgccagatatgagcatgttcgatattatgatcgtttgagaaactcctaagcttcattttcagttcttctatcgactcggccgtaaatgcaagccgctcagccatcggttctcttcccgcctgaagcgtgtaagcgatcttggccaaatccccgtcagaacgtttttttcttatgacatcatccagaagctggcgggcgcgctctttcaattgctgctcatttcgtgctgataaaataataacagccggtttttgcggagaaacagacgcgttttccattggtttcaggctgtcagacggcacatattcctgaatgatgacatgcgcgtttgaacctcctgctccaaatgaggaaataccggcaattctcggatattctttcatttcacccgtgatatttaagacaggtcgtttccattccgtttctttttgctgtacgaaaaacggagtgtgctcaaactcaatattcggattcaattccgccgcatgcaatgaaggggcaatcctcttatgtttcaattggagaagcagtttggtgattcccgcaatcccggcagcgctttctaaatgtccgatatttgatttaattgaaccgatggaacaaaactgccggtcttctgttgtcaggcgaaaagctttcgttaacccgtcgatttcaatcggatcaccgagcgcagtgcccgttccgtgggcttccaagtaactgaccgttctcgggtgaatgtctgtccgtttcaacgtctctgcgatcagatcaaactgcgctttcggattcggcaccatataagcgtttgtcctgcctgctgcgttcagcatgcttcctttgataacgccgtaaatatgatcgccgtctttctccgcttgagcaagcggctttaacacaatcgcccctactccttcaccgtcaacaaaaccgtccgccctgtctccgaaagatttgcatttatcaccgggagacagcattgaaaaagcggacagccgctcatagtgagccggatcaacgataagattgactccgccggcaatcgctgtttcactcattccgctccgcaggctttctgcagcgagatggacagctgttaaagaagaagagcaggctgtatccactgccatactcggcccttggaaattgaacaaaaacgatactctgtttgcgatagaccagtcgctgggaactgtcgggtaattgctgttcatcacaccgacaaagactccgattttccggctgtcacatagcgtggccggggtgtaccccgcatcttcaatgcttgaataagcagtctgcagaaacaacctttcctgcgggtccatcctttcagcttccgcgggagatatacggaaaaacagcggatcaaatttatcaatgtcatcgaggaaaccgccccattttgaataaatggacccccattttccgcgttcctcgttataaaacgttttccagtcccagcgatctttcggcacttcagtaatagaatgcctgccggcttttacattttcccacagctcatcaacgtgatcggcgcccggataccggcctgacagaccgatgacagcgatatcctggatatagggatctccgtttgtcctgctgccttcctcgttttgaggaattacattcaggttatctgtgtgatcagacagctgctcctcacgcacacccattgctttcataaatgctccccgctgagaaagaagcaggtaatccgcgatttcttctatcgtctgatattcaaaaaagagggtgctggtcatttggtcaaacacgttacgaaaagcatttgtaagcctgacgaccagaatagaatccaaaccgtatgcggttaaggaaaccgacggatccattctcccgctcggaatcttcagcgtttttcctattaattccgtcagatatgtgatgccccgttcccttacgtttggaatcggcgcggcgctttctgcgggagcctgcacccgttcggcgttttcaggatgagcccgtccattcccgaattgccgctcgagcgcttctttacgggaagacagaaagtaatcagcaagctcatcaatggtttgatattcaaaaaacaaagtgctgctgacagaaccgaagacgtcttttaacgcgttggtcagtctgacgaccagtatggaatccaatccgtatgcggttaaaggttcatgggataaaagacgatgcgccggcactttaagcgcttcaccgattaccttcttcatcagttcaacgcttttttctctcaagctgaaatgcaaggtatcatccgaaagaccatctgcgtcatacggacggcgctccggtttttcttctgacgcctgcgggagggcaagcctgaccgttccgtcactttcagccgctataatctgctggcccaagtcgtgtgcggcttcagccggaaacagaggatggacgaatccttcaagtgaaagcgcttccgcccagccggccggctcaacccccggacagcccggaatccgtaaatcatgatcctcatacagccaccagccttcaagaaggccgaatgtcacatggttaaatatggtgcggctgttgatctcatttataaacaactggccgtttttttgcagcattgctttcgcatggcgcagcgtagagcggatattttttgtcgcatgaagcacattggtcgcgatcactgcgtcatacgtgccgatgtccggcacttctgttgataccggctgctcagcgttgaatattttataagtgacataaggatattccggaccgaatatgtcttctgcatgtaaaagaaatgctttagaaatatccgtgaaacaatattcggcaatatgcgcttcatacggtttcaattttctcatgaccgcggcgctcgtcccgcccgttccggctccgatttctaaaatgcggattttcgcctgcgggtctttttccagacgttcccgcagaactgcaatcaatgtgtcagcaagcttgtcattgaaaaaatcagaaatgatattattgcggtaaataccttccacaagacggaaagaggagtctgggaacatcacttccgttgccggaagcttaccggttaaaatgtctggaagcacacgcaatgtctcttctgccaatctgacatgcgccctcatgtctttctggcgcagccaagtctcttttttccgctcccattcctcccacacctgccctaaatccgttttttccggagcaagcgctaattcagtcaggaagacaaagctctctttcagccatctgctgtattgttccgttatgccggcagccgattgaaataacggcaaagtctcatcaagccttgcgcccatctcataaagggttgatacaagtattttttcaatgagggattccatctctctcatgcagctcatgacatttgatgcttttacccgctcagcttcgtcattctgcgtgatgttaaccgctaattgtccgagtgcggaaggaatcttttccggataaaccgttacttgttctttcagatcatctttcataaaaaccggatctgtcgttttgatcagcgccagctggtcataaggtcccgaaagcagggtttccagcgttttcatcgcttcgggcgcctcaatagaagcgattccgtcccgctccatccgtttccggtattgttctgaagcgacaacgccgacacttccccaaaagccccaattgacaacctttacggcatacggcgctttttgtgagatccgcttagcaaaagcgtctttaaacgtgcacccggcggcataattgctctgtcccggcgctttttgaaacgacatcatcgaagagaaaaacagcaagaaatccagcggttccccttcagctacccgggcaatctgcaagctgacatcagtttttgcagaaagtgaagcgcggaactgctcctcttccatattggcaaaacttcggtctgataacacgatggcggaatgaatgattccgcgcacctttccatgttccttcacaatggtgtcatacgcccgcttgagagaatcataatccgcagcatccgcgctgaaatattgcggtgcggggcctaaagccgcaagtcttttcagctttctttcaatctgtgtatcttttttccgtctcccgatccagacaattttcgcctgataggtctgaatcatatattcagtccatacttctcctattccgcctgctccgccgataatcacataaaccccgccgtgccggtataatgaaggctcacctgcatgaggctggcagacggccaattgctggcggtgccactgacctgcacgaaagacccacggatttccctcggggtccgccggtaaagaaaaaacatcgggaagatgccggtctcccctttgagattccaaatcaagaagccggatgctccaattactgtattcttttgcgagcgaccccgctaatccgtgtatgcttgcatgactcggattgacctcatcatgttcatgaatcggctgtgcttgaaacgtgcagattgtcaatgatagttgttccgtgtcaaaattcagaagcagaagcgattttaccagccggaaaagctgcatgaccccgtgctcctgtccgtcggccgtatccgcatcataaacggatggaatcggatgatccggcgcagcccatatcatgtgttgaaaagagccttgcgctttcagtgtttcagccatttgttccgcgctgtccaaagaagtgatgtccggaaaacggacatcggaatacatctctttcaaagcctgctgaaaatccggcccgcccccgatgacgattattttttcttcacgcatgaaagacatgccggtttccggaatggtgacggtgttccaaaccggtgtcataagcaattccgtttcacggcttttcttcggcgtgacgccggctttttggttaaacccggcgctttcctgcacctcttttatgataaaatctttcactgccgccagcagcacgccgcgctcatcacaaatatgcagatcaaattggtgaacggaggcggcttttacctccgcatgcacaaatacggttttcgctaacggtttaagcagctgtatttctccgaaggaaaacggtacgataagcgcaggctctttttgaaattgcagcacatgcgccattgcggtttgaacagcgccatccattaaggacgggtgcaggatgtactgtttaaaatcggcttccaagtgtgacgggagcgttaatttggccagtgctttcctttctgtataagagaattcgcggatgacctgaaaactgtccttttgcacgattcccgccgcagagaacgagtgatagatgtctttcggctccgttctctgcacaaatggcgccggaagctgaaagaccgaggcctcaaaaggcgctcctttttctttacaaatcacttctccttgcgaaaagagagtgccggccgctcctttttccttaatgacatagcttatacgctctttttccgcttcaaactctatcatgacggatcttgggtctgtccctgtcacaatcggctccatgtaccacacattttggagagagacggccggacgttctccccacaatgccgcgccgtatgccgccatttccagatgacagactccggggagcacatatttttcgttcactaaatgatctttaaagaaatattcatccttggaaaatatcttttgaaacgtccctttccgggcggatgaaacattctcatcaagcagcggatgcagcgcttcacgccttttgatagattggggctttttcgtataccgctttttttgatcggtcagccaggacgtttcctttaaaaacggatacgtaggaagcggaactttctgatacggcgtctccggctttttgaaaccttgaaggcctttgacccacagcgcggcaaatttttcaggatctgaaacggattggcctgaaacgtccggccgcccgggtgacgcttttccgaagtaaatatgcctgccgtcactgtggccgctgacaaagccgtccaatcgctgtttcagctcggaaagagatgacgcaatgacagcaagccggaaggagaaaggctctctgcctgacaatagggtggcagcgatattttccaggctgtatccgccggcagaaggcgagttttccaatcgggcaagaaaggagctcaatttcccggcatattctttcagctgctgttcggaatgtgcgcttagtacgacggcatgcggtttttgctcagtattcccgtccgcttgccgttttggctgataagcacctacgatcagatgggcattagagcctcctgcgccgaacgaactgattgcggcgattctcggtttatctccttcagccggccacgggcggttgtttcggacaacataaaatggcgaatcagaaaaagaaatcttgcggttcagttcctcggcgtgcagactggcgggaagcgtttcatgtttcatgcttaaaagcaccttgattaaaccggcgatccctgcagccgcttccaaatgtccgatattggatttcaccgagccgattccgcagtcatttttctcatcggcctgtttctcaaatgccatagacagaccgcgtatctcaatcggatcgccgagtgccgtgccggtaccgtgagcttcaatgtagctgatatccgccggacttaccgcggctctgtttatagcggataaaatcaggtcccggtgcgcttccggattcggcaccgtatacccggtcgttttgccgccgtggttagtggcggaccccttaatgacaccgtagatgtggtcgttgtccgcaatcgcttttttcaatggttttaacaaaacggctcccgcgccttcgccgggcacgtaaccgtctccgccttcaccgaaactgcggcattttccttcagaagacagaaaatgcgattggcttaaaaacatgtatttttgcggatgtaagctgaggttgacgcctccggccagcgccatttcacagtcgcccgacataatggcctgacaagcctgatggacggcgacaagcgatgaagaacacgccgtatcaacagcgatactcggtccatggagatcaaggaaataagaaacccggttcggaatcccccaatataaggagccggggcctttatactgatctttgaggaaaccttcttcgtgtgcaattaatgaatattcattccaggtcactccggcgaatacaccgatttgatccgtcggcctcgccgccgggttcccgtaaccggcatcctccatcgcttcccagcagcacgtgacatacagtttttgctgagggtccattaaatcagcttcccacggggaaacagaaaaaaacagcgggtcaaatcgatccggacgatcaataaaacctccccatttactgtatgacgcgtattctgccgttttctcttccgagtaataagagctgtcccatctgtcctcagggatttcggagacacaatctttattttccattaaattgtcccaaaaatcatgctggttttccgctttcggaaacatcccgctcattccgataaccgcaatatcagaactcctgtccgttcccggttcgggcaccttttcagccgcctgtacaggaagcacttcttcctgccggcttcccgtatcaggctccgtttctttgaattcaagaacgctttcgggatttcgtttctgcgtacttaaaaactcactcaatttctcaatgttcggatattcaaacagcagcgtttcagaaaggccggtaaattctttatgcaatatggtcatgatttcttcactgatgagagacgtcacgccaagagtaaaaaaagcggttttatcttctgcttcggtcacctcggcacccagcttttccgctattaccgttcttaaaaattcgttaatacatttcatgaggataccatcccttgtacaaaagaatttttctgtgctttaacaagttaatccgccgtctatcgccattgtctgtccggtcataaaggacgattcaggagaaagcaggaaacgaacgagtccggtcatatcgtctgtttcgcctaaacgccccatcggcgtccttctgataatctgcgatttttgtttttccggcatatttttcgtcatatcggtgtccacaaaaccgggcgcaagtgaattgacacggattcctttggacccgagctccctggccagacttcgcgtcaagccgtcaagagccgctttggatgcgctgtagactgaagtgcctttaaatcctcttgaaccgataatggagcttatgttaacgattgatccggaattttgtttcagcatgacccgggaaacgtttcgggtcagcttgatgactgaaccgatattcagattgaggatgcggtcaatgtcttcatcattggtcaggggcagcagctgatcaaggttcaaaccggcgttattgaccaagccgtctattctggaaaacttgcggtatacttgaagaacaaactgtttcatggcggcatcatccgccgcatccgccgcttcccaataaaagcggtcacggtacttttcactctctctcaatgtgttaataaaatcagattcactgcggctgaaagcggctactttgtaattctcatccaaaagcgcctgtacaatcgcttttccgagcccccggctacctccgctgacgaccgctacttttccgttattcatatttgcctcctgttttacacgtttcttatttttttaaatcggtcattagacagtttccgatctgtaacagagatgatctgcggtatctgatatggctgcagcttctgtctgcaatgagctacggcccgctttctgaaagatttgatatcttcctctttttcaagcacggcctctgccgcgacaatctcgcccgtaatcggattttttcggcccgttatgagaacatcccggacattcggtatctccagaaagacgctttccacctctgccggaaacactttctctccgcccacattaataatttcactctttcttccgagaattcttatatattcgccgtctgtttccacctggtcaccggtgtcgtaccagccgtcttcatcgaaaggtgagggtgcgtttaaatagccgagcatcgccgactcagaacggacccaaagcgtgcctccggtaattttggtctctgttccggcaccgcctactttcatccaagtggattggctgtcttttgatttcgttgagaatatacccaattcagttaatccgtatgtttgtttcagccgtacatccggaaacagccggtgaatgccgcgcagcgttgattggggcatcggttctgtgccgtaagtgatcagctggagtgaagacaggttatagccggcatccgccttggacatcagcagcatgtttaaaaaggtcggggtggcggggagcacttggacagcatgtttgtcgaccgcctgataaacggactccggcgttctgctgtctgatgtgacgatcgttcccccgttaaacagaatcgcaaacagcgtattaatgccgcctatatgatccaatttcagaaaaatgagcgtacgcagcggttttctcttcgccgttttgtatttttcaagcagccggccggcgcttaacacggatgctttgcttttgccggaggttcccgatgtgaaaataataatgcctgactcccctctctctcgcaggtcatcaagcagagggtgagaggcgctttcagaaccttcacgaagcgtccagctgtcattttcatttatttcaatgatttgattcactttcgcgtcttcaaacatatcaagatgcttttcccttgattcattgctgagagggacaacgatatttcggtttaacaaaagcgccatcagcaaaaaaatggcgttcggggaataatccccgataagcgccacacattctccttcacgtattccgttttgttcaagttctttctgaaaaaagctgattcgtgtcagcaaatcatcatacgtaaaagtctgccctttaaaaatgagaaactcactgtcctgcgtttccctaagcttatcagtcacccagctgatatctcccctgctttctgttttcatgattgagcactgtccatatatttttgataaatatcacaaatgctgccgacggttgtaatgctggaaatcgtttctccttgggaaaaaggatctactccggtttccatctccatctgtgcgactaattgagcgatatccagtgatgagaagcccagatcctctatgactctcacatcatctcccgcttcgacggcccgatatgactgctgttcttgaatatcctgaatgatttgagcaatgatctgcttcatttccttggtttgttccatttgctttcagctccattctttattttataaacttctgatgacccgtttataatccggaatatgatcttgtgaagaggtcggcaccgccagcagcttatccaccttggaaatggccagcaatgtatgattccttttcatatagacttcaatctgatagctgattttcgccactgagatcataccgagggactcaccgtgaaagtcgggatcgcattcttcaatgtgtcccgtcatataaatatcaagctcttcatctgcaaaacaatttccgtaataatacgtctctctttcaagcaaaaataaatgccgcgcgattgaaaccggaaaacccggcttcgatcggcgcgtcaaccactcaaattccgccgcatccattatcttgctgaatttcgcaaacaccatggcatgccccggcgcagcatcctgatcaacaggaacccgatatgaaacggggtccgctgttttgaggttgcccggcttcataccgaaagcgtccgttctgattttctttgaccgcatcagcgcgtaaggcggcttggctaacttagaaagttccgcaatgcattcagccttaggcgctgagactttgcgggtcgaaccttctgtttgtgtgacgtcgacgactattaaactattggctttcatagaaggaaaccgtccccggtcccactcgcttttatcagagctgaccgctcctttcggcccgaacaaataatcagattctaatatggtttctccaaaccgggagatatcgactccgacggaaacctcgtcccataatcggtactgatcaagaggctgatctgaaggaactttgagatgtgtcataaaataagccggatacaaaatcagcccttggtgatcggccatctgatcaggccggaatcccgttccgtccgttaaatggtgactgtgtgcgttgccgaataacagcagcagcgcgtactcattcaaattccctaatccgacatggctcatcgttaattcatgattttcaatcagcatggtagtcctccgcagaaaaaatgtaatgtctggtcatactcagcctgtaatcgataccagcctttgcgccagaaggccggctgtttcttccatgagctgtttgccgatcaagtcgacatgcctgtttctccaattttcaagcggggttcctttcacccattgattaaacgcgccgagtgcagggccgcaatgaatttggtaatctattttactttcgctttttccttccagagcgagcctcgtcgtatgggaaaaataccatttaaataccatcgccattttgtgtttcggattctgttcggctttggcgatctgttcaggagatttatcacgtttcaactgctcatacacttcctcaaaactgcgctggaaatacttatcttcaattaatgttttcgttttttcatctatttcatctaaagaattgtattgtctgtacaagtcaaagagtttattggctcttgccggaaaaaacaggccttttttcagcacctgcacccttgcccccgcttcaaacatgtctcccgcgggagcgtatgacgtatcctgcacgttcgcttcctgaagcagatctttcactgaatcacttgtcccggcttcgaccgtgcattgattaatagaaccggttccgataaattcggcgccgagcagaaacgcggcagcagccgcttccggagtgccgatgccgcccgctgccccgattcttacttttttcgcatacccgtgcttctccatcatgcggtctctgagtctgatcatggcaggcattaatgtatacggaatcccttggtcggtatgccctcctgaatccgcttcaacgcaaatgtcatcagccatcggaatttcttttgcaagcgccgcttccccggctgtcagccgattgtcagacacaagtctttccagcacatgagccggagccggattcagaaaggcctcagcgacttcaggccgggatactttcgcgatgattctgttttgaactgacaccgacccgtcatgattcctgcttaatccttttgccctgtatatcacgagagccggggttatgcccataaatgccgatgcttcaataagatgaatgccgtttttcaaatataaatctatcattctgacttccttgtcaggtgacatcatatgatgaagaagattcattccgaatgtttccccttgccgcagtgcagaccggatggttccgatggcctgtccgatccgttcgatactcaatccgcccgttccgaaaaagcctagcattcccgcttttgccgctttaatgaccatctgttccgaagcaattcccctgtacatggagcccgtcatgtaagcatattggatgttataatcttttttaaaatcttcgttccctaatctcattcccgccgttttttgtgaatcagctgccgatgctttaacatcagcagtatcagactcttctttcggcattggtaatgggacggcatcttttttaatctgccgcgtcagttttgtcagcacttccccgggcccgacttctgcaatttcattattttcaagccccatcagacggcgtatcgtgtccgtccactttacctgattggtcatttgcaaagtcagatttgttttgatttcatcattcttataaggtgcggcatgaagatttgagatcaccggaaaacgaagaggcaaaaacgccgtttcttctaaataatccgcgaactctttttcagcatctttcatatagcgggaatggaaggcgccgctcacatttaaaggaagatacattctcacgccggctttttcaaagacggggcccgctttttcaatgtcttgtttcgttccggcgatcacaatttgagaaggtgaattgtggttagcgatatcaatgccggtcagatgataatcggatagaacctcttttacttgttcagccgtaaaccccaaaaccgccgccatgcctccgggagctgccttgctcatgagctcccctctttttttcacaagctgcaaaccggtcttaaaatcaaagcagccggccgcaaataacgcattatattctcctaaactgtgccctgcggcgtaatcgggctctctgccggactctttaatcttctttaaataactgagtgcacttaccgtatataacgccggctgggtaaattgcgttttccccagctgatgactcggatcctccagacacaattcttctatagagtagcctaatatgtcatcagcctgacgtgtcagatcttgaaattcatcaaacagcccggctcccattcctttaaattgagaaccctgccccgggaacacaaacgtaagcatcttatcctcatcctttccgcatcgtcaatttgaatatcacatgtggttctcaatgcaaaaacgtctcgctcatttcatatattgactggtgtaaacaccgccataaaaataaaaacacaaacgcgtttgcgattcagcacaggtttaaaaatcgcaaacgcattgtgttttccttttctaacataatttatataaagacatcttgcttgtttacagaatgtttcgcatgacaagctgcagtgccaatatgcccgaaaacagccatgacggcacacttctcccttatcatgtatatgtagatatatacactgcaatcatttttataatccctatttcctcttcaacgtgccgaaacagcgattgaaatttaataggtgctttactttaatttaataaatttaacaaatagttgctatttaaagagaataatatcaatttatagataataatgtcaaggctttatttcgttattttctgacatttattccacagttttatgttcggtggacagtcggcataattgtttcgggataaatgtcagataattccctgaacccttttcatgtcaaagaaaattcatcacctctctgtcaattgggtctatacttatttttcattttcatatattatgtaaaaaaaagacgaattagaaaattttttaatcactttaaatactatccattaaatactttctttgtataataatttcttattattctaaggaggatccagtcatgaaatggtacgcactttttgtagagtcgggaaaagaagaagcagttcaaaaatttctgcgtctgcagtttgatgagcaggctctctactcaatcatacccaagaaaaaagtcacagaacgaaaagccggaatcaaatacgaggcactcaaaaagatgtttccgggatatgttctgtttaaaacaaagatgacagagcggacatttcataaaatcaaagaactccccatttcatgcagaatcgtgaataacggcgcatattattccaaagagcgtaaaacctatttcacgacaattaaggatgaagaaatcctccctattatcaggctgatcggagaaggagacactgtagattattcaaaagtctatattgaaaattcaaaagtaaccgttgcctcagggcctcttaaaggaatggaaggcattattaaaaagatcgataaaagaaaaagacgcgccaaaatctgcctgtcttttatgggactggacaaaatggtcaacgtcggaattgaagtgctctccaaaccctagcatttcaaaaaaagcatcaacagcatgtgccgttgatgccctttttatataaacagacgaaagcccgacatcaaaataaccccgctcaccaccgtcacggtcaaatttttgttttcaaggcatagttgacctgaagccgggctgcgcctatgagacaaaatcacatttaggggaatccattttaatcaagagcggtgaattgacggttgagcttcatgacgaaaaccatgtgctgacttcgggcggtgccgcacaattattttcattcctcggatgaaccggtgacatattttatgctggtctattatcctgaaccggcttaaacgcatatcaggcttcttcagacagaagcctgatggaccgcaacccattcttgtatgcattgaatcagtttctggacagaaggtgtctgcgtctcctttgcatgagctgtcaaaatgccgagctgcctggagacataccggtcgaaccgtttgatgagcacatcacaatcattcaccaaaagctgcggcaggatgctgatccccagattgttccgcaccattgcaattatcgcttcatcccctctgatttgataagcgacccgcggtgtgatcttttcttccttcagcactttcagcacatcaaaatgtgtctccggataaggcacgatacatttgacggattccatgacatgtaacggaaccgtttcacattgcgccaattcatgctgcgggctcatcaccgctacaatcgggtcctcggccaacgggtaaaaatgccacttctcgctgtgggatgtcccgatcgccgcatcaatccggtcatctttcagccattgttccagctcagtagaatttccttcaaacaaatgcaccttaatagaaggatacagctcattaaattccctcaagattttcggcagccattttaccgccacgctcgtaacagtgccgagccggacttcccctctttctaacccattaatattatcaacggtttgagacagtttttcatagtttttttgaatttccttcataatatgtaacactttcaagccatttgcggtgggcctcactccatgccgctgtctgatcaaaagcggaaaaccgtactcttcctctaatttactgatcatttggctgatgttcggctgtgtgtaattcaatatggcagcggcctgggtcaggctgccgctttctaccgttttaataaaggctaaatgcttctttaaatccaaccggcttcatctcccagatatcattacttattatccaatgcattagttatatttagtttacttatacatcaatcaaaaataaaatggcaatgtctccatcattatacttaataacaaacagaaggtgagcgtttcagcatgagttttctcattcaattttttatcggcggcaccgttatggtggccgccgcgtatttaagcaagtcgaaatacttatttttatcaggcgttatcacattgctgccgatcatgacgttactgaatattcacttgcagctgaaaaatatgagccccgacgatttcagagcagctcaaaaaaacggaatattcggtgccttcggcgcagtgatcttcatcagcagtattttcatcctgacaaactggttcaaaggaggccacgcagtcatcggtgcgtttctcatctatatttgctatatgatcggctgtaaatgcctgttatgaagatacggccacgctgtgtataaaaaaatgcccgtccagaacaataagaacgatctgttcagttgtgagcagtttatatgactgaatgatcatgagttgttataatcaatgtctaaaaacattccgggaggcgaaataaatggcgagaaaattattcacaccatggaccgttaaagatgtaacgatcaaaaaccgtattgttatggcaccgatgtgcatgtattcctcacatgagaaggacggaaaactgcagccttttcatatggcgcactacatatcgcgtgcaatcggacaggtcggcctgattatcgtggaagcgacagccgttaatcctcaggggcgcatttccgatcaggatttgggcatttggagcgatgatcatatcgaaggttttgccaaactgacggaacaagtgaaagcgcaaggatctaaaatcggcattcagctggcgcacgccggacgtaaagctgagcttgagggagacatttacgctccgtcagccattccgttcgatgagcagtccaaaacaccggctgaaatgacgacagaacaaattaaagaaaccattcaggaattcaaacaggcagcggcgcgcgcgaaagaagccggctttgacattattgaacttcatgccgcacacggctacttaatgcacgaatttttgtcccctctgtccaatcaccgtacagacgaatacggaggctcacatgaaaatcgctaccgcttcttaggcgagaccattgaagccgtcaaggaagtctgggacggcccgttatttgtccgtatttctgcatcggattatacagacaaagggctggacattgcggatcatatcggttttgcgaagtggatgaaagaacagggagtcgacctcattgattgcagctcaggcgcactcgttcaagctgatattaacgtcttccccggctaccaagtgagcttcgcggagaaaatccgtgaacaggccgaaattgcaacaggcgccgtcggtttgataacgacgggaacaatggcggaagaaattctgcaaaacaaccgcgctgaccttatttttgtcgcgagagaacttctgcgcgatccgcactttgcaaggagtgcagcgaagcagctgaatactgaaataccgtcaccggtccaatacgacagagcatggtgatgaagtgacagccggagtttttcgatccggctgtctctttttttatttttcgagaaacgattgccgaagcttctccgtcttccctatagaaccaattagaggagatgactccaatgaaagcagcatggatggaaaggacatatctgattgacgggtgtccgttttatacgaaacaccgtaaaggcgccggcgaagtgacgatcgtctttgaagccggctacggcacttcttctgaaacatggacatcattactcgctgacatagatgaagaatttggggttttcacatatgacagagccggaatcggcaaaagcggacgaagccgaaacaagagaacggcggaccatatggtacaggaattaaacgctcttcttctgaaggccggcgtcaagcctccttaccttgtcgtctcgcattcatacggcacgattatcagcagactttgggcgagccggaaccgccgggatattctcgggatggtgctgcttgatccggtttctgaggatcaggagacgaaagtgcttccgcttcttcctgaagaaatgaaggccgcctatttgaaacagttcaaattggaaggatcacacgcggaatttttaacgagccttaggcagatccagcatcagcagattcacttcggcgatatgccgctgttgattttatcatcgggagagcgggatgagcgcttaaagcacactcatgaacaatgggtgaaactgcacagaagcatgcttgatgtctcttatcaaagcggatggattcaggccaaaaacagttctcatgccattcaccacgatgaaccgcacatcgtccaccttgccatttatgatgtttggtgcgcggtgcgccagcaaatgaatgctcctgcctatcaggcggtaaactgataaaacaaaagccattgtgcaacggcacaatggcttttgttatcgtgatctattttgtctcacgatgcaaagtatactttttcaaccggggtgaatactttttcatttctaaccggtccggattcgtccgtttgttcttcgtcgtgatataatttctgtcccctgtctctgtacaggccaatgtaacattcacacgcatcattttcaccccttatataaatcgtaattattacgttttattatatctcatcagaaaaaaatgtcaagcgtctattttttaagaccgctccacagtgacctccatgaagtcaaatgcgatcttactgttctcaaataccgctttcgcctcatgttcgagacgctctatcggcgattcaccctgataccttgcgctgatatgagttaagatcagctgtttggcgcctgctttttttgccgtttgcgcagcctgttctgtcgtcgcgtgataataattatgtgcgagctttgcatcttccttggcaaacgtcgcttcatgaacaagcacatccgcattgcgcgcaagctccgttacccgctctgatgccctcgtatccccggaaaaagcgacgattctcccttttttcggggattccagaaaatcccgcccgttaatgattctgccatcgtcaagtgtgaccgtttcgccttttttaagtttctgatagacgggtccgggcgggatattcatttctttcaatctgccggcctgcaatgcgccgggaatatccttttcctgaacccggtagccgaacgcttccacaccgtgaatgacggatgctgcggtaacaatgaattgctcatcttcaaaaaccgtcccctcttcgatttcatgtacggtaagaggatacgtcagatgagtcgccgtcacgttcaggcttgtttcgataaaggctttaatgccttttggcccgtaaatcgtcagctcttcttcaccgccctgaaatgaacggctccccaacagacccggaagaccgtaaacatggtcgccgtgaaggtgggtgatgaaaatcttttcaattttcctcggtttgattgttgtatgtaatatctgatgctgagtggcttctccgcaatcaaacagccatacggaacgcctttcttcaagaagcttcagcgcgacggacgttacgtttctcgtctttgccggcatgccggcccccgtccctaaaaataataattccacaatgcttcctcctagatctttgtactactaaggatacaggatcagactgaaaatgtgaattcacccgggccttctccggcctgattaatttttttccgcaaaccgcaaaaaacaggctgaaatgtttgctttcaacgaattttagatttaaaatgaaggaaatatgcggggttttaaaccatgcttcagataaagtgaggtactctaagtgaaaacaaacgacaaaccaaaagcagtaattgtaatatttggtgccacaggggatttggcaaaacgaaaactttacccatccattcaccgtttatataaaaatggtcaaattggtgaagagtttgcagttgtaggtgttggaagaagaccttggtcaaacgaggacctccgggaaacggttaaaacgtctgtttcttctgccgggcaaaaagacatagacgatttcacatctcatttttattaccatccgtttgatgtaacgaatccgggttcctatcaggagctgaatgtcctgcttgatcagcttgaacatacatatgaaatcccgaacaacagaatgttttacttggcgatggctcctgagtttttcggcacgatcgcaaaatcacttaaaaacgaaggtgtcacagcgacaaatggctggtcccgtctcgtcattgaaaaaccgttcggccatgatctgccgagtgcgaaagagcttaacaaagaaatacgcgaagctttcacggaagatcaaatttaccggatcgaccattacttaggcaaacaaatggttcaaaatatcgaagtcatccggtttgcgaatgcgctgtttgagccgctgtggaataaccgctacatctcaaacatccagattacgtcaagtgaagatctcggcgttgaagaccgtgcgagatattatgaaaaatcaggcgcactccgtgatatggttcaaaaccatattttacaaatggtcgctctcttggcaatggaaccgccgattaaactgaacacggaagaaatccgcagcgaaaaagtgaaggtgctgagagctctccgccctgtcgctccaaacgaagtgagtgacttcttcgtccgcggacaataccaagcgggaaagattgacggaaacgctgtaccgagctatacagatgaacaaaatgtagcaccggattccaatacggaaacattcgtgtccggaaagctgttaatcgataacttccgctgggccggcgttccgttttatatccgcacagggaaacggatgaaagaaaaatcaacgaaaatcgtcgttcaatttaaagacattccgatgaacctttattacggcaatgaaacgaatgtaaatccgaacctgcttgtcatccatattcagccggatgaaggcatcacactatatctgaacgctaaaaaattaggcggagccgctcatgctcagccgattaagctggattactgcagcaactgcagtgatgaaatgaacacaccggaagcctatgaaaaattaatccatgactgtctgctcggtgatgcgacaaactttgcccattgggacgaagtggcgctttcctggaatttcgtcgatgcgatttccgaaacgtgggcagccgacaaaaccctttctccgaattatgaagccgggtcaatgggaccgaaagcttcggacgatcttcttgaaaaagacggcctccactggtggaatatataagaaaaaattaaaaaaccgcggcgccgttcatgacggcccgcggtttttaatatcaggaaaagcccccgcaatcaatgcgggggcttcttcattacttcatccattcagtatggaaaatgccttctttatctgtgcgttcatacgtatgcgcgccgaagtaatcacgctgcgcttgaatcaagtttgcaggaagcactgccgtacggtagctgtcgtaatacgcaagtgcgcttgagaacgaaggtaccggcacgccttgggctacggcaagtgaaatcacttggcgaagggcgccttggtagctttctgcaatgtttttgaagtagctgtctaacagcaggttatcaagctccggttcacggtcatatgcgtctttgatcttttgcaggaacgccgcgcggatgatacagccgccgcggaagatcatcgcgatttcaccgtatttcagatcccagttatattcttcagacgcggctttcatttgggcgaagccttgtgcgtaagaacagattttactcatgaagagcgcttttctgaccgcttcaatcagctcttctttattttcagtgaccggcttaacgtctggtccggacagaaggccgcttgctttcacacgctcttctttcattgcggaaatgaaacgcgcaaaaacagattcagtgataatcggaagcggcacgcctaagtcaagagcgctttggcttgtccatttacccgttcctttttggccagctttatcaaggatgacgtcaacaagcggtttgcccgtttcttcatcttttttagtgaaaatatcagccgtgatttcgatcagatagctgtcaagctctcctttgttccactcagcgaatacttcgtgaagctcttcggcagacaatccgagcacctgtttcagaatgaaatatgactcagagatcagctgcatgtcaccgtattcgataccgttgtgcaccatttttacatagtgccccgctccgtccgggccgatgtatgtcgtacaagcttctccgtccactttagcagaaatggcttctaaaatcggttttacgagttcgtgcgcttccttttggccgcccggcataatagaaggccctttcagcgctccctcttcaccgcctgatacacccgttccgataaagtgaatgccgctttcggcaagctctttgttccggcgctgtgtatctttatagtatgtatttccgccgtcaatcaaaatatcgtctttttccagatgaggaagaagagattgaatcgtcgcatccgttgcagttcccgctttaaccattaataaaattttacggggtgtttcaagagactggacaaactcctcaatgctgtatgtaccgacaacatttttgccttttgcctcttctaaaaactcttccgttttgctgcttgatctgttgtatacagacacagaaaatccccggctttcgatgttaagagccagatttttacccattaccgcaagaccgataactccgatttgttgttttgacatattctaacgtcccttcttcaaacgtttaaccattttaaaatttaaattaaaataaaatgatatttatactaaagaaattatcatacataaccccttttttcaagttattcaccttttcttttcatcctgaaaaaagtctctgttaaagctcgttccccttgttttgctttcttctttttttataacggcgccttttctgatcaggttttggccgtacttttcattcagctcgttcatcatctgaaaaatcggctcatcctttgcgtcctccttgaatgaaaacagatcaagctgtttatacgcctgctgtttttcaaccagttccgtcccggtgatgccgagaagccttaccggattttggttccagtgcttgtcaaacagttccatcgccgcttccatgatgtcttttttctgatcagccggattgctgagggtcatgcttcttgtgaccgttttccaatccgcataccgaatcatgatgaacagccggcaggccatgacctccttacgctggagccgttcgctcacagacagcgcaagccggtcaaacacgcccgttaattcatcccagtcagccgaatcatgcgacagggtggatgagttgccgacgcttttaaattcataaatccgctcgggattgacttctgcaggatggatgccgttcgctttatccttcagcctcgggccgtttatgccgagaagcgttttcagcgcatgttcatctccttttgccaaatcaccgatcgttttgatgcccagcgtttttattttttccgcagttttcgttcctataccgtgcatctcttctatcggaagaggccataagacgtccggcagctctctttttcttaaaatggtgatgccgagcggttttttcatgtcagacgccattttagcgagaaatttattcggggcgatgccgatgcttgacggaagcaaaagctctttttgcagtctcgcctgaatgtctgcggctgtctcatacgccctgtgtctgtgcggtgtgtccgtaatatccatgtatccttcatcaatagaaacaggctcgactaaatccgtatactcccacagaatgctgaacatttcttttgacgaactccggtagcggtcaaaattcggaggcacgacgatgagttccggacagaggcgttttgcccgccacaccggcatggtggtctttacgccccgcgctctcgcttcgtagctgcaggtgacgatgattcctttccgttccttcacgtttccggcaacggcgataggttttcctcttaaagacggatcatacgccatttctacagaggcataaaaactgttcatatcgatatgaaatataattctcccttttccggccactcccggcgcctcctttccttatatagacaaccttatatatatgtagtaaaataagagctgaatggatgtgataaaatgattcttgagtcaatgaatgactttttatttttagtcgattttttcacaattattcttcccgctctgaccgcgatcggcatcgcttttcttttgcgtgagcgccgcgcaggcgagcattggagaacgaaacgaatagatgaacatcaagcagtcgttcagctgaaccgaacagactttcttattattatatatcatcgcattacaacttggatacgtaaagtcatccgcatgaattcaccggcgaatgatgatgaagatgtcagcttcctccttttataacggcaagtgaagataaaaaggaggagacataattgtctaaaacatatcaaaaatggattgcattcggattgttttttatcgtactgtgcacaggccgctcggcttttgcggcgacatctcagactcagacgggaggcctcgggaatatcggttttttccacgattacctgatcgagccgttttcggcacttttaaaaggggtggcgggcctgttccacggtgagtacggactgtcgattattctggtgacgattatcgtccggatcgttgtattgcctttgtttgtgaaccaatttaagaaacagcgggtgttccaggaaaaaatggctgtgatcaaaccgcaggtcgacagcatccaggctaaaataaaacaaacgaaagatgcggaaaaacaaaaagaactgcaaatggaaatgatgaagctttaccgtgagcacaatctgaatccgatggcaatgggatgtcttccgatgctggtgcaattcccgattttgatcggtttttattacgccatccgctcaacgccggaaattgcttcacactcatttctgtggttcagcttagggcattctgatattcttgtatcactgtgcgcgggggccatgtatttcttacaggcttatatttcccaaaaattaaaccagaaatattcaccggctgctcaaaatccggccgcgatgcagtcagcaaaaatcatggtctttattttccctgtcatgatgaccgttttttcgcttaacgtaccggctgcgctgccgctttactggtttacaagcggactgtttttgacagtgcagaacgtacttttacagcagacgcatcataaaaagaaacaggctgcggctcaggcggagcccgccaaatcataatactgaaaccctgccggaacctatccggcagggtttttttcttgtatctgcaaagctttaagccaattatcttatcatgaagaatgaaaaaagcacccaatcaactgggtgcttcgtttttagttggccgctgtttcgataatggcaacgaccatttccgccgttttgacgagctcttcaatcggcattttttcatttttcgtatggatttgttcatagcctactgacaggttgactgtcggaatgccgtggccggcaatgacgtttgcgtcacttccgccgccgcttgtctgaagttcgctcggacggccgatttttgccgccgcttttttcgcgacttccacaacctgatcgccgtcctgatatttgaaacccggatacatgaccgcgatgtccacttccgcgcggcctcccatctcagctgcagcagattcgaaagcttctttcattttctgcacttgcgcctccattttttcaggcactaatgaacgcgcttcagccagaatatcaacctggtcgcagacgatattggtttgcgtgccgccttcgaaacgtccgatattagccgttgtttctttatcaatacggccgagcggcattttagagattgcttttgatgcgatggtaatcgcggagatgcctttttccggttccactcccgcatgagccgttttcccgaaaatggttgctctcactttcgcttgtgtcggcgcggctacaataatgttgccgacttttccgtctgaatcaagcgcaaaaccgtatttcgcggtaatgtctgaacgatccattgcttttgccccgactaatcccgattcttctccggccgtgataatgaattcaatggtgccgtgctcgatgttttgttctttcagcactttaatggcttcaaacattgcggcaagacccgtcttatcatcagcgccgagaatcgtcgtgccgtcggattttacatagccgtcttccacaatcggcttaacgcctttgcccggaacaaccgtgtccatgtgcgaagtgaaataaatcgtatccgcatcttttgtgccctttaacgtacagattaagttgccggctccatgcccggtcacttcttttgtatcatcttcttttacgctcaatcctaaatcagtgaatttttgtttgagcaccttgctgatttccgcttcatgttttgtctctgaatcaatttgaacgagttcaagaaattcttcaagcagacgtttttcgtttaccattttcagttccctccgtttaaagcggtatattaccgtgcttttttttcggtctttcctcttccttatgcgcaagcatgtcaaatgcctgaatcaattttttcctcgagtcttccggccggatgatatcatccaccattccgcaggccgccgctttatacggaccggcgttttccttttcgtatatggcttttttttcgcgcttcgtcttctccgggtcgccagaagcctgtatgtctttgctgtataaaatcgacgccgcgccttccgctcccatcacggcgatttccgcattgggccaggcgaatacaagatctgccccgagccctttcgaattcatggcaacataggcgcctccgtaagcttttctgatgatgagcgtcactttcggcaccgccgcttcggcaaaagcatacagcaattttgctccgtgacggatgattcccgcatgttcctgctgaaggcccggaagaaatcccggaacatcagcgatcgtcaatagcggaatatgaaacgcgtcgcaaaaacggatgaatctcgacgctttgtcagcggcatcaatcgtgaggctccccgccaagtgtttcggctggtttgcgacaacaccgactgtacgccgtccgagtttcagaaaaccgacagcaatgtttttggcaaaatacggctgaatgtcaaaaaacgttccgtcatccgccagctcttttattacctgtaacacatcgtaaggtttcgaactgtccgcgggaacgagggtgtttaataacggtctggcgtcttcctttttaacgggtaatgccgtctgtccgccgtgcgggagataagaaagcagggttttcacagcggaaagtgcctctttttccgttcgtgcggaatagtgggcatttccgcttatcacattatgtattcccgcaccgcctaaactttccgcgtcaatctgttcacccgtcacctgttcaatgactttcgggcctgtaataaacatgtgcgacgtatgttccgccataatcacaaaatccgtcaaagcgggtgaataaacagcaccgccggcacagggcccaaggatgacagaaatttgcggaatcactcccgagtaaaggacgttgcgcctaaagatatgaccgtatccatttaatgataccacaccctcttgaattctcgcaccacctgagtcgttcagcccgatgatcggggttttgtttttcgccgccagatccattaccgccgcgattttttccgcatgtgtctcgccgagcgtcccgccgagtacggtaaagtcatgggcaaacaaatacacgggccgtccgtcaattgtgccgtatccggtaacaacgccgtctcccggagcattctggcacccgggcgtgcggcttttggcaaacggctgcagctctgaaaaactgtcttcgtccaatagatagtcaattctttctcttgccgtcagcttgccttttttgtgctgtttttcatttttttccgctccgccgccgtttgttaaaaaggaacgtctttcgtttaagtgtctgatatgatcactcatgctcatcttgagtttctcctttttcaattgtttcacaaagctcaatcaggaccccgttcgcctcttttggagagagaaatgcgatcttcttcccgcccgctccgttttgcggttcatgatgaatcaaggtcatgcggcatgattcaagctccttgatcgtttccttcatatcggcgcagcggaatgccaaatgatgcagcccttcgcctcttttctgtaaaaaagagctgacgggagacgcgtccgacagcggctcaatcagctcaagctttgtgcctcccgcttctaaaaaagcaactctcacattttggccgtttaccagctcgtctcccatatacgtaagcccgagcatccgttcgtaaaatcctctcgcggcttcaatagagctgacggcaatgccgacatgatcaagttttttcatagcgcggccacctgctttccgccataggatatggcttgttcatacaagcaaaacacgttaaaatggtagacagtaatcttaaggagtgaaacaatgtctcaaaaatttatgaaaagcgccgtcatcgtcattttgggcgtatttatactttcaaccctcctctcaggcattatgatgtatttgcggtaaaaaagcaggcgcctcattgcaagggggtttcctgcttttttatgagggctttccgctctattgcaatgtcctcgaatgagcggttttcttttgtaatcaatactttcgttccgggagggataatccggaaaatacggatgacatcccggtttttcatacggatgcagccgtttgatacaaaccccccgatcagctcttctctgtttgttccgtgaatgccgtatattctgccgtcggtgcctttcgcatcaaaaccgatccagcggacgccgagcgggttttccggcgcgcctccctctacatttttcttccggtaatacggattgacggctttgaccgttaccgtaaattctccttcaggcgtcaaatcatccgtttttcccgtcgctacctgataaatgccttctattcggttatccttcacaacagcaagcgcgtttgtggctttattgacgataatataagggtcacccggcaaagggttcgcgccaagcggccaaagcggagacagcagcagggcggctgacaataaaaaaaatcgcatgggctcccctccttttttcattagaatgaccaatgaaaggaggactcatgcgattgatccatatgttttttacagcttgatgcctttgaaataacttttaatcacgagatattgttccatctcaccgaggaggtggaacaaagccgcccgcgcttcaaactcctcgcgcgttgccgggagcggcatttcttcaaattccgttctcatttctgcaagtctttttaaaaatttatgagcggtattgccgggatgaatggcttcccttaattcatggatgaaatgggcgattatttttccctgctccaccgttattgaaatagaggtaatcttcggcagcagccgttcaatgatttcaaattgtttctgtctcatcttaaaataatgatagtagagattttcatggcgcaaaatatgattctgcacgtcccgataggcgaggtttttcgcctcttgaatcatctgatgcgtctccggtatttccttccccgtccaatcttgctcaccagttaacaaataccgttcgatttcggcgaagatgacggaaaagttgtcctcgatttttttcctgtacgccgcgagttttctgtcgaggctcggcatatacagattcattaacagcgcgacgccgatacctacggtgatcagctggaactcattccagataaacgccatcgtaatgccgccggacatatataaatgaagaatgattactgaactggtgacgatcccttcatttatttttaaaacgactgtagtcggaatgaacagcaccagcaatattccgatcgcaaacggataatagccgatcagtccgaaaaagacatatgagaagacgatcgccaataaacaggcggcaaatcgggcccacgaggcctgaagcgaccgcttttgcgtaatctggatgcacaatatggtgatgattcctgcggatgcgaagttttgcagatgcaacagctgggctaaataaatggccagcgccgttccaagtgcggtctttagtgtccggtaaccgattttaaacattgcttgctccattctgtttgtttctttctcaaaaaaaagaagaagagcattcttcttcttttcttacagttatattttataatattttttctaaaaagtcctgtgctctttttgacttcggagaaagaaaaaattcttccggctgaccgtcttccacgatcgtcccttcatccataaataatacgcggtctgcgacttctttggcaaatcccatttcgtgcgttacgatcaccattgtcatgcccgtctgcgcgagctctttcatcacctcaagaacttctttgaccatttccgggtcaagagccgaggtcggttcatcaaacagcatgatgtcaggattcatggcaagcgcccgcgcgatggcgacccgctgcttctgtccgcctgacaaacggttcggatagtcgttccgtttgtcaagcagtccgactttttcaaggagagcgcatgccttttcctccgcctcctttttagactctttcttcacgctgaccggcgcgtatgtgatattttcaagcaccgttttatgaggaaacaaatgaaaatgctgaaataccatgccgatattttcccgcactttcagtttattcgttttagctgcggtgatttcgttttctttaatggcaatcgttccgccgctcggggtttccagcagatttaagcagcgcagaaacgttgatttgccggaaccggaagggccgatgacagcgacgacttccccttcttcgatctgtgttgaaatgtttttcagtacttcatgtttcccgaatgattttgacaggttatcgaccttaatcattggctttcagcttcctttctacgccttttccgatgaatgctaagatcaaaacgagcacgtaatagattaagcccgccacaataagaggttctaaatagttgtatgttgcggcgccggactggtaggcccgtctcataatgtctccgagaccgattaccgtgacgatcgccgattctttcgtcaaggtgattaattcgttaataatagccggagaaatgtttttaaacgcctgcggcagcagcagatctttcatcatttttccgtacggcacgccgagagcgacggcagcctctttttgtcctttgtcaattgcgttgattcccgctctgataatttcagagacgtaagcggctgaattgagcgataatgcggtgaccgccgcccaaaattgatcgatctgaaagccgagaagctgcggcattccgaaatagatgatcatcagctgcagcacgagcggcgtgccgcggaatatcgaagtataaaaatccgcaatccatttcagcggactgatcgtgctgattttaaataagctgagcacgattcctaatacaagaccgatgaccgctgaaacgagcacaatttttaatgtgaccgcaaggccttccaatataaaaggaatttgggggattgtcgctgagaaatccaaattcatacgtgtgatctcctttgtctttattcaagataaaaagctcaacgaaaagttgagctttcttttatttctcgttggtgaaccattttttcttcagtttttcgatttctccgtttttctccatttctttcagcgctttgttaaacttcgctgtcagatcactgtctttgcggaacgcaatcgcggagcccgattcgtctgatttcgcatccgctgacgcaaagccctgcagatcgttatttgaactgaaatagccttgtgctacgatgtcttcgataatggcggcatcaaaacgcccggatttaatctcttccgttaagtctgagatccggttgcggtcttcgagctgaaaaccgtatttcgaagcgagcttcttgcctttttcctcttgaatggagccgagctgaacaccgacggttttgcctttcagatcattcagggatttaatgctgcttccctttttcgtaacaatcatattgttagcagtataataaatatcagaaaaatcaacttgctttttccgttccggcgtaggtgtcattccagataaaatcatatctatctgcttggacttcaaggctgtaatcaggctgttgaagtccatgtcctgcacctcaacgtcatagccggtctttttgcccagagcttttgccagatcaacgtcaaacccggtgatctgatcgccgtctttatattcaaatggtttatagtcagccgatgtacccataatcagcttgttctttccgccctctgagcctgaattgcctgatccgcaggcggacagcgcaatggtgatacatgcggcagctaataccaacagccatttcttcatgattcatttcccccatatctactgatctcttaaatttgaatatttattcgttaacttgtattttaaacactttttaattgtgatgcaatactatttttgaaaaatatattttcctttctgtgtttattatagtcattgtttttccgattagtgacagctgaacgccgatgtataaatatttatatttatacagattccatataaaaaaaccccgaaagcgctcggctccggggtttttctttcacttatacttcttcacaatattcttcaaatgcttcctgcagttttgtgacgacggccatcggctcatggccttcaatttcatggcgttccaccattttcatgattttcccgtcttttaaaatggcaaatgacggagaggacggcggatagccttcaaagtattctctcgctttggctgtcgcttctttatcctgtccggcaaataccgtcacaagctgatccgggcgtttatcgtaatgtacggaatggtatgcggcaggccgtgcaataccgcctgcgcatccgcacacagagttgaccataacgagtgtggttccttttttcgaaagcgcttcgtccacttcctcagcggttttcagctctgtatacccggcggccgtgatttcctggcgggcttgacgcacgacatcattcataaataaattaaaatccatattcaactgggacctctcctttttgatcatctcttcttatgatagcaaggaacctccctatcggcaaatgacaccgctcatatccaattgtttttgtcccttttatgtacccgatgtaagtttatgaccttttaaaaacgggaaacttgttaaagagattgtctgaaataaaggagcagtcgtatgagccaacggaaagcagtattaatttataacggaaacgccggtcaaaaacagattgataaaacgctcggcacggtcgtccccattttggcccagtcagctgacgaacttttgattaaaccgaccaaacatcaggatgatgcccgtcagtattgtgaaaatctcgacagttcagttgactatttatatattttaggcggagacggcactgtgcatcaatgcatcaacagcatcagtaagcttgatcacaggcccgctgtcggcattttgccgggaggaacgtgcaacgatttctcaagggcgctcggcatcccgcaaaaccttcaaaaggccgctgaagcgctcgcgcccggacataaacgaatgattgacgtctgtaaaacggatgacggctattttctgaacttttggggcatcggattgatcaccgaagcatcaagccatatcaatgaaactgaaaaagcatggctcggtaaaatcagctacttcacgagcgccttgcgaacgatgacaagcgcgaacccgttccctgtcaaattgacgattgacggcgaggtgaaagaagacgaagccgtaatggtgcttgtcatgaacgggcattatatcgggacaaaccgagttcccctgcctgatgccagcctccgggacggcttagccgatgtgttaatctgccgcaacacaagccttgccgcgttgcgggagctgatgacgatggagcagggttcatttgatgatttcaaaggggagctgtcctatattcaggcctccaggattgaaatcgaaaccggacgtgaaatggacgcggatacagatggcgaggtatacggaacaacgccttgtacgatcgaagtgaaaaaacatcatctcactatgcttgttcccgaggattcacaatgaaagtaaaaaagctccttttgccgcccgggcaaaaggagtttttttaatagactgaagtattttcgtcaatgttttctaagatttctttgacgcgtccgaggaatcggccgcacacgagcccgtcgagcactctgtgatctaaagacaggcaaagattaaccatatcacgaacggcaatcattccgttattcatgacaaccggacgtttgacgatagattctacctgaagaatcgccgcctgcggatggttgataatgcccatagattgaactgagccgaaagatcccgtgttattgacggtaaatgtgccgccctgcatatcttccgcggtaagttttccgtttctcacttttttcgcaaggtccgttatttctctggctatgcctttaatcgttttttcatcagcatgcttaataaccggaacaaacagcgaatcttccgtggcaacggcaatagagatgttgatgtctttcttttggacgattttgtctcccgcccacatgctgttcatctgcgggaactctttgagagcctgcgccgccgcttttacaaagaaagcgaaaaatgttaaattgaagccttctttctgtttaaatgagtcttttatgctgtttctgtacgccgtcatgttcgtgacgtcgacttccatcatcgtccaggcgtgcggaatttctgttttgcttttatgcatattggcggcgatggcttttctgacgcctgtaaccggaatctcaatatcaccggctgacagagctggcgccggcgcttgtttttgctgttgtttcagcgcttgttgcgttgtttgaacggcggccggcgccggtgcttccgacttctgctgcattcccgaatcaatgatcttttgaatgtcttttcgcgtaattcttccgcctgcacccgttccttcaacttcttcaagctgaatgccgtgttctcctgctaatctgagcacggccggtgaataacgcgctttatttgactgatctttaccttgacggtttgcatcggtgtctgaaggggtattctgctcttcttcccgcttcggcgcctcttcggtttccgtttcttccgtttcaattttgcagatgatctcgccgactgtaagagtctggccttcttctcctacaagttctgtaatcgtaccggtaaaagaagacggcacctccgcattcactttatccgtcatgacctccgcaatggggtcatatttattcacttgatcaccgggggataccagccacttgctgatcgtcccttccgtcacgctctctccgagctgaggcatagccatttgttcaatcgccatgtcaaaaacctccttacgtctttaaaactccgctaattctctcatcgcggcttctgctttgtcaggattcatcatgaagtatttttccattgtcggcgcataaggcattgccggaacatcaggacctgcaagccgcttgatcggcgcgtctaaatcaaataagcagttttcagaaataatggcggcgacctcactcataataccgccttctttcgtatcttctgtgatcagcaatacttttccggttttagacgcagcttcaatgatggcttctttatctaacggataaaccgtacgcaaatctaatacgtgcgcggaaattccgtctttttcaagacgctcggcagcctgcagagcgaaatggacgcataatccgtacgtaatgacagtaatgtcgctgccttcgcgttttacatccgcctttccgatcggaaggacgtaatcatccgcagggacttcgcctttaatcagacggtacgccctcttatgttcgaaaaacagcaccggatcttcgtcacggactgcggctttcaacagcccttttgcgtcataaggagttgaaggcatgacaattttaagacccggctggttggcaaaaatggcctccacagactgggaatgatacaacgcgccgtgcacgccgcccccgtaaggcgctctgatgaccatcggacagctccaatcattgtttgaacggtagcgtattttggccgcttctgaaatgatttggttgaccgcaggcagaatgaaatcggcaaactgcatctcggcaatcgggcgcatgccgtacatcgcggcgccgatcccgacaccggcaatcgctgattccgcaagcggcgtatccatcacccgctcttctccgaactgttcatagagacccgccgtggctttaaacacgccgccttttctcccgacatcttccccgagaacaaaaacgcgcggatctctttccatttcttctttcattgctgcattaatactgtcaatataagacattacagacataagtattcctccctacttcgcataaacgtgatcaagcgttgattcaggagatgcgtatggcgctttctccgcttcgtctgtcgcttcgtttacgatagccatgatgtcatccagcatggtcttttcttcttcttcacctagaagcccggcttcttgcaagtatgctttatataaaagaagcggatcttgtttctttgcttcttctacttcttcgcgttctctgtagctgctgtcgtcgtcatcactggaatggggcgtcaaccggtaggaaaccgtttctattaatgtaggaccttcgcctttagatgcccgttcgcgcgcttctttcacggcccggtaaacttccagcaggtcgtttccgtcaactgtgactcccggcatgccgtagcctgctgcgcggtcggaaatattttcgcacgccacctgtttgtcatacggaacagaaatagcatacttattgttttcacacatgaaaatgaccggcaatttatacacggcggcaaagtttgccccttcgtgaaaatccccctggttggaagatccttctccaaaggttacgaaagagacgatatcctttttatccatgcgtcccgcaagcgcgattccgactgcgtgaggcacctgcgttgtcacaggggatgagcccgttacgattctgttttccttttgcccgaagtggccaggcatctgccttccgcctgagttcgggtcagccgctttcgcaaaaccggacatcatcaagtcctttgcagtcataccgaatgcaagcacaactcccatatctctgtagtaaggaagcacatagtcggtatcacggtttaaagcataggccgcgcctacttgagccgcttcctgtccttgacatgaaacaacgaacggaattttgcccgagcggtttaagagccacattctttcgtcgatttttctggctaacagcatggttctatacatttcaacggcttcttcgtcagagagccctaatgcttgatggcggtttgtagtcattcaaacccctccttctttccttttaaaaatgaatcgcgtttccgtctgcggctaacgcagcttctccaatcgcctctgaaagcgacggatgcggatgtatggactggccgatttcccaaggcgtcgcgtcgagcaccttggcaagccccgcttcagagatcatatcggtgacgtgcgggccgatcatatgaacaccgagaatatcatctgtattccgatcggcaacgattttcacaaagccatcgctttctccgtatacaagagcctttccgattgccatgaacggaaacttcccgatcttcagttcatgtccttttcgggttgcttcctcttctgtcagaccgacactcgccgcttccggatttgaataaatgcatttcggcacaagagctgcatcaagcggagccggattaagacccgccatatgctcaacggcaatgatgccttcacgggaggccacatgtgcaagctgaagaccgcccacaacatcaccgatcgcataaatgtgcgattccttcgtctgcccggcttcgttcacgatgatagaaccgttttccgcttcaatatccgtgttttcaaggccgatcccttcaatgttcggctggcggccgatggaaacaagcatttgttccgcgtgatacgtttctttttttccattcttttcagcggcaattgaaacgccgtccgctttttccaatgtatccggaagcactttcgcacccgttacaatcttaattccttttttcgttaacagtttttccatctcgcttgaaatatcatggtcttcagtcggcaaaatgcggtccgcatattcaatcacagtgatattgacgccgaaatcgttcagcatggatgcccattcaattccgatgacaccgccgccgacgatcaacatggattggggcagacgctcaagctcaagcgcttcatctgatgtcagaatatatgtaccgtctgcttctaaacccggcagcattttcggctttgaaccggttgcgataatcaattgtttcggtatcagcatgtcgttttcttcaccatttgcgtattcgacggaaaccgtaccgggaagaggtgagaagatggaagggccgagcatacgtccgtacccgttgaatacatcaatcttcccctttttcatcaagtgggcgacaccgccggccagacggtcaacgattccctgctttcgtttttgcacgctgtcaaagcggagggagacaccttccgtttcaatgccgaatgctgccgcttcctttgcggttcggtacacttccgcgcttcttaacagcgctttactcgggatacatcctttatgcaggcatgttccgccgagcttttctttttctacaacggccgtttttaagccgagctgggccgctctgatggcggctacataaccgcccgtcccgccgcccagaatgaccacatcatattcagtcgccatttgttttcactccttcgccgatctgatattgctttgactgctcctcaccggctaaaacccgaagcgcgccttgcgcgagagattgcagttcattttctcccgggtacaccagtacatccgaaatccaatctatgtacgatctgatggcggatacgaaacttttcccgtacgccaatccgcccgtcaggacgataatgtctacttttccttttaatacggcgcttgccgccccgatttcttttgctacttgataagccatggcgtcataaatgagcctcgcatgctcatctccggcctgaatgcgtttttccaccttcaccgcgtccgttgtccccaggtagccggagagtccgcccgtgccgacaagttttttcatcatatcggcttttgaatacttgccggaaaaacacatctccaccaaatcacccgcaggaacggttcccgcgcgctccgggctgaagggcccttctccgtgaagcccgttgttgacatccgtcacccgtccgcaatcatggacaccgactgtgatgccgccgcccatatgagtgacgatcatcttcatctgttcataccgtttgccgagggacgccgccgcctgacgggcaacagctttttggttcaaagcatgaaaaatgcttttccgcttgatttcaggcatccctgatactttagcgagcggagtcatctcatccaccacgaccggatcgacgatatacgcggggatatttagtccgtcagctatttccctggcaataattccgcccagattagaagcatgctggccgttgtagccgtttttcaaatcagtgatcatggcgtcattcacttcatatgtgccgccctcaatcggtctgagcaggccgcccctggcacaaacggcatcaaactttgaaatgttgatgccctgttcgtgcaaagactcaagaatgcttatttttcgaaattcgtactggtcgataatgccgttaaatgttttcagctcttcttcgggatgtcgcagcgtcttttcaaagatacagcgttcattgtgaaagacaccgattttcgttgatgttgagcctggattcagaatgagaatgcgtttttccttttcgaacattttcatacctccagatcaaattcctatcgtctgcttaatatactttggccgttttgcagaaactggcttcttgaacggcgcatgcgttcaattcgttcctcagccagacggtcggccgctaagtatgtcggaatgccgtcacgcgcggaaatatcgagcacccgctcaatgtttgcatagatgccttcaacttttttcaaagcccgctcagcattgtagccgtaaagctcatcggccacattgatgacgccgcctgcattgatgacataatccggagcgtacacgattcccatttcatgaatggtatcgccgtgacgtgtttctttcagctggttattggccgctcccgcaatgactttcgccttcagctgtttaatcgtgtcatcgttaatgacggcgccgagagcacatggggcataaatatcgcacgtctgtgagtaaatgtcgccgggatcaactgcgcgggcgccgaagtcctcaacggcacgtttaacagattctttattgatatccgttacgattaaagaagcgccttcttcgtgaaggtggcggcatagattgtaagccacatttcccacgccttgcacggcaattgttttaccttccagtgaatcagtgccaaacgccgctttcgctgcggctttcatccctttgtagacgccgtacgccgtaaccggggacggatttcctgatgaaccgaatgccggagaaattccggttacatagtctgtttcatcatgaataatgtccatatcttcaacggtggtgccgacgtcttccgccgtaatataccttccgtttaagccttggatgtagcggccgaacgcgcggaacatttcttcatttttatctttgcgcgggtctccgataataacggttttcccgccgcctaagtttaaaccggcagccgcatttttataagtcatgccttttgcgagtctcagtgcatcttcaatcgccgcttcttcactgtcatatgtccacattcttgttccgccgagtgcagggccgagcgtcgtatcatgaatcgcgatgatcgcttttaatccggattgttcatcttggcagaataccaattgttcgtaatcgtaagtctccatatatttgaaaatttccataggttcgttcctcctactgttcttgtgatgcgcaaatcgcaagcgcaattgaatacagtttattttctgcggtatccgctctgctcgttaatgcgatcggcgcttttgcaccggcgatgacggcagcaacatttgctttcgcaaaataaatcattgacttataaagcatatttccggcctcgattgaaggaaccaagagaatatccgcctggcccgctacgcttccggaaatccctttttgcagcgcagccgcttgggatacggcattatccaaagcaagcggtccgtccgcaatgcagccggtaatctgtcctctattgcacatctggacgatcgcagccgcgttcagcgtcgcctccattttcggattaaccgtttcaatagcggcaaggactgcggctttcggcatagggttccctacagaatgtgcgacatgaaccgcattttgcagaatatgcccgagctcttcaagagacggggcaatgttcagcgctgaatcagtcacatacatcagccggtcatagtccggcacctcaaaaacggctacatgtgataacaccctttttgaacgaagcccttcctggcggtttaaaaccgatttcagaagagttgagctcgggagattccctttcattaaaacgtccgcctcttgttcacgcactgcgcgcactgcttttgccgcagattcttcgggtgaatcggcgtggatgatgtcagcattgaacttcggctcatttgccagaagctctttcagctttccgctgtcacccgtcagtaaaaatcgtgccgacaagtgttctgccgccattttgacggcctggatcacttctttatctgctgcgtgggccactgcaatggtttttgcgttttttgccgcggctttttcaactaggtctttcagcttcattttgtaccacctttcttgtgcgaatccgcttttaacaatgcaagttccgtgccaaatatgcgaaagggtttattccggcttttttcaagaacacatgcagctgtttgcgctttctctgcaacttattgcatgccgtcatttgcaaggccgtacttgtccattttgtagtacagattccgaatgctgacaccaagcgctttcgccgttttggttcggttgaatttatgcttttcaagcgttttttgaatgacgtgcgcttcaaatttttcaacagcctgagacagcttttccccttctatatccggaaaatcactttgggtgccgtttttttcattcagctctgattcgaaaacaggcagatgctgctgttcgatccgttccatgtgcggctctaaaaatatcattgcccgtccgagaacattttcaagctcccgtacgtttcccggccagctgtaggctgataaagctcgcagcgcgttcggcgtgagcccctttacattgcggccgtaatcctgattgattttttcaatgagccgaatgctcagcgcttcaatatcttctttgcgctgccgaagcggcgggattgagatcggatagcggttaatccggtaatacaggtcttcacggaacgcgccttccgccatggccttttcgatgttgacgtttgtcgctgcgataattctgacattgacagaaatcgctttagcgccgccgactctgataatttctttttcctgcagaactctgagcagctttgcctgggtgctttgggtcagctctccgatttcatctaagaaaatgctgccgttattcgcttcctcaaaaagtccttttttgcccccgcgcctcgcgcccgtaaacgcgccttcctcatagccgaaaagctcggattcaagcagggattcagacagggccgcacaattgacccggatgaatttattgtattttcggtcgctttcattatggatggcgtgggcgaaaagttctttccctgtgccggattctccccgcagcagaatcgtcgccggcgttttcgccccgagcttcgcctgttcaagggcgaccagcatttgttcactcgtgccgataatgtcatcaaacgtgtatttcgcttcaagcgtgcggataatctggcgcgcccgattcagctcagcagtcagcgttttaatttctgacacgtcgtggatgacgccgacgctgccttttaaaataccgtccacaataacgggggcaacatttacgatgacatcctttttattggggccgaccttcatcctcacaccccgaacgggccgccttgtccccaatactttcaggtgcatgctttccccttctgagatatcggtggaagcgggttttccgatgacctcgctttctgacagcccggtcatttttgtatacgctttgttgattaacattccgatgccgttttcatcaacgacggaaatggcctcgtctgacgattgaataatcgcttcaagcatggtgcggatttgttttaagttcgtgacctcttccgccagttcaactgcgtcggtgatgtctttaaacacgcataacgcgccgagaagctttccgccttcgtcaatgatcggcagtcttgtcgtaacaatctgcaggtgcttgccgagaagctgcttctggttatattccggctctctcgtttccagaatccgcggcagctttgtgttcggcactacatctttaatttggcggccgatgacatcctcccgttttcggccgaccattttttctgccatctgattaaataaaatgatcgtttcgttgacgtctataaaaatcatgccgtcgtgcgttgaattaaaaatccggtcatgcttatacgtctgcgacttcagcatttggataagctgctgtttttcctccatcagctgaaacaccatgtacgccaattttcccggcatgacgatggtttgttcttttttctcatggagcagctcatccatgaccgctttatcgcctgttgtatggatgataatatctatatcttcagttatgtagggtttccaatctgatgaggttgcaattccatatctccgggcttcttgcagcccttgcgcctccggatcttggtcaaccaccgcaataatccggatcagttttgttttcatcaaaatctgtaggagcgccgtgcctcctttaccagcacctataatcagcaccttctgcatcccgatacccctttatatgaaaaaatttgcacacctgtatttcccgttgcaataatttgcacaacccctatgttaccacgttttgatctcttgacaaaatattttttcgattggacaataaaggaaatcatatcgtaaaggggttttctgaatatgagccggcttgttgcacttttgattctggtcctccccggcgctgtcgcggcgctcggcattaagctgatgagagatgcattattcgggcatgcgttttccccgtttccgtccctttttcttcagggggcggccggattggcgttttttttgttcggcctttatgtcctggccgggtttattctgtacagagatcggaaacgcaatcaagtcagcccgcggttcaggaaaaaaaagctgtaaaaaaagcccttgcaaaaaaagggctttttcagtcgtccggcagtatcgttttggcaatggattgatccagttcttcatagtcatggtaagcgatcgtttcatataattcttttctcgtctgcatatccgaaagcccctctttttgagagccttcttctttcagaaggcggaaaatacgttcaaaagccttggccgccgttctgagtgacgtgaccgggtaaatgaccatctgacagcccatatcggaaaattcatcagcactgtaatacggcgtttgtccgaattcagtcatatttgcgagaatcggcacactgatttgtttggaaaacgctctgaattcactttcggattggagcgcttccggaaaaacagcgtcagcacccgcttttatataagcggacgccctttttaatgctccctccagcccttcctgctgtctggcgtctgttctcgcaacaacaagaagagtcggcgcggcccgcttgaccgcttggattttttgcgccatttcttcaatcggcacgagctgcttcccattcagatgtccgcattttttcggcaggcgctgatcctccatttggacggcggccgcgcgcgcttcatacatttctttcgccgtccgggcggcattcagcacgcctccgaaacccgtgtcaatatcgacgaggacgggcagatcagacgagcggaccagatctttaacccgttcagccatttccgccgacgtgatgatgcctaaatcgggcagccctctgctcgccgtgtaagccgcgcctgataaataaagagccgaaaaacccgttttcttggcgataagagcggccatcgcatcgtgagcgccgggaatctgcaatagatccggcgctgccatcagcgtacggaaccgctctgcaagctcctcttgagacgactgcttgctgacgatccacgtcatgtttgtcaccctcctattttatatgagaaataagtccataaattcactaacgctgagcttctgcattcggccgctatctttacaggcctcttcgattttccgctgctgcttcaatgaaaaatgagtgctgatgtttgctgaaaacttggcaagaatcttcggaacggcttcttttctgcggaatcggtgcccgagcggatattcacattcaatccgtcccgtagccgtgccgtctgtaaaatgcacctgtacggcatttgagatggatcgcttattcgggtctaagtaatctattgagtacgctttatgttctgtcacctccattttgctccgcaatgtatcaattcgcggatcagacgccgtttcctcttcataatgatccgccgtgatatctccgaaaagcagcccgattgccgtaatatactggaggcagtgatcccggtcagccggattgtgaagcggcccttttttatcgataatccggattgccgactcatgggtcataatcgtgatcctgtcaatgtcttcgatgcggtctttcacctccggatgaagccggaccgcgcattccgccgctgtctgggcgtggaattcagccgggtaggatactttaaacaaaacattctccatcacataggacccaagccggcgggcaagcttcatttcctgacggttaaataatacgtcttgaaatccccacccagatgcggtcagagccgtcgggtaccccatttcacctttttgcgccataagggccaaatatacgcctctgctcgtcgcgtcgccggccgcccatgatttgcgtgatccggtgttcggcgcatgacgatacgttctgaggcttgaattatcaatccaagcgtgagatacggcgttattgatttcctctcttgagccgcccagcatttgtgcgcaaacagccgcagtcgccactttcacaaacagcacatggtcaagcccgactctgtttaaactgttttccaaagcgagaattccttgaatttcgtgcgctttgatcattgcgcaaagcacatcacgcacggtaagcggttctttcccttctgaaatccgcactctggatatataatccgcacaagccaatatgcctccgagattgtcagacggatgcccccattcggccgcaagccacgtatcattataatcgagccacctgttgatacagccgatattaaaggcagccgtgaccgggtctaaaacaaaaggcgtgcccgggactctgctgccgttgggcacggaggttcccgggacaatcgggccgagcagctttgtacattcgggatagctgagcgccaaaattccgcagcctatcgtatcaagaagcacatgtcctgccgtagtgaaagcttctgaactgtcaatctcctgatggagcacgtagtcagaaatctcttcgattacagcatccattcggcggggttctgtcatgttttcatcttcctttctcatctgtttacaggcgcgctccggtatagcggacacgcgggcggaaaagccggtttcggctgtgctgttcaatgacatgagcgcacagtccgaccgtccgtgcgctgaaaaatataggcgtatacagcgggatcgggatgccgagcatgtaataaaccggcgctgcgtagtaatctaagttcggataaaggccttttttctcccgcatgacggtttctccggcttcacacatatgataaagacggaaatcgcctgaaagatcagacagttttttcaatgcttctttcatcatgagcgccctcgggtccatttttttcatgtagacacggtggccgaagcccatgattttttctttgtttgcgagtttttgagttaataattgtgtaaacccgtctgtatccttcgcttcctcaagcatgtacataaccgcttcgttcgctccgccgtgaaggtttcccttaagcgaggcgacggctccggtcagcgcgccgtaaatatccgattgcgtcgaagcaatgacacgggccgtaaacgttgagttcggcaattcatgctcactgtataaaagaagcgaccggtcgaatatttcttcttccaaggaggacggcgtttttccggtaatcatatataaaaagtttgcgctgtacgataaggttccgacaggcgctaaaggctccagtccgttgatgactcgatagctgttgacggtcagattgggcattttgcctatcagcccgcggacacggtgccgatttacagaagaggtgcggttatcaatatccttatcaaagcctccaagcgcggacaaacctgtcctcagtccgtccatcgggtgagtacgttcgggcagcagacggcatatacgcaagatttcctcgggaaggtgtccgccgcgccgaacgtcttcttctagcgccttcttctctttcgcatcaggaagtctgtcttccaataagagatgaacaatgtccatatagccggccgttttagaaagctcaatcagatcgtggcctttgattaaaatactgccctgctgtgtatccaggaaagaaatccccgtttccaccgcaatgacgccatctaaaccgggagaataagattccatggtttcgctcctttgcgcactttttattgaagaagatacttagaaataatcagcctttgaatctcattggttccttcatagatttgcgtgactttcgcatcccgaaataaacgctccgcgggatactctttcatatagccgtagccgccgtgaatctgaacagcctccaccgccgctttcatcgccgcatcggacgcgaactgcttcgccatagatgcttcttttccgcacggaagccctcgctgatacagatcagcagcatgatagaccaataatttggcagcttccgcattcgttgccatgtcagataatttaaatgaaacggcctgattcgaagcgatgggtctgccgaactggctgcgggttttggcgtactccaccgagcagccgagcgccgcttcgataatcccgagcgcctgagccgctatgccgatccgtccgacgtcaaggtttttcatggcgattgaaaaaccctcgccctcttcgccgagccggttttcaatcggaatttccgcttggtcaaactgcaattcgacagtattggaacctaacaatccgagctttttttctttttttccgacagaaaaaccgggtgtgtttttttcaacgataaacgctgaaattccctttctccctttacccggatcggttatggcgaatgtcagatacagatctgccgctccgccgtttgtaataaagatttttgaaccgttcagaatatatgaaccgccttttcgcacggctgttgttctcaggcttcccgcatcagatccggagtgaggctcagtaagcgcaaaagccccaatatattcgcccgctgccagcttcggaatatacgtttgtttttgggcttctgtcccgaaatgcaaaatcgggattgtccctaccgatgtgtggacggacaaaatgacgccgacggccgcgctgacttttgatatttcatgaatcgctaaaatgtaagatgttgtatcagcacccgccccgccgtaagcttccgggacgggaatgcccatcaatcccgcttcgcccatttttttaatcagccgctccggaaattcatctgttgattccatgagctcaaccaccggcgcgatttccttgcgggcaaaatcacgcaccatttttctcatcatgatgtgctcttctgtaaaatgcatggctgccgtctcccctcatgatctttacatcatctgccgtactcataaaaaccgcgcccgctttttttgccgagccagccggcgctgacatattttctgagcagagggcatgggcggtatttcggatctccgagccccgcgtagagaacctccataatggaaaggcacgtatccagcccgatgaaatcagctaacgttaaagggcccatcggatgacgcatgccgagcttcatcacctcatcaatcgcttcctttgaagctgctccttcgtaaaggcaataaacggcttcgttaatcatcggcattaatatgcgattagatataaagcccgggaagtcattgacttcgacaggggttttattcatccggacggcaagcttctttactgtttccgccgtttcttccgatgtggcgagtcctctgatgacttcgacaagctccatgacaggaaccggattcataaaatgcatgccgattactttttcaggcctttttgtggccgcggcaagctccgtaataggaagagaagacgtattgcttgccaatacggcatgagggggacagattttatcaagtgtgtcaaacaattccgcttttgcttttttgttttcggcaatggcttcaatgataaaatcagcatctcccgcttctgtaagctctgccggggaaatacggctgaaaacggcatctgtctcctgctgtgacttccgtccttttgcctgctctttctccaggtttgtctttatgcggtgaagaccttttgttaccgtttccggctcccaatcgtataaattgacggcaaacccggcttctgcagccgtctgagcgatgcctgcccccatctgaccggcacctgcgaccatgattgttttcatcttcatccggcgctccctcctttgatcagtacacctccagcaggacggcatctccttgagccgctccgctgcatatagccgctatgcctaaacctcctccgcgacgctttaattcgtatattaaactcatgatgattctcgctccgcttgcgccgatcgggtggccgaacgcgattgcccctccgtttacattcactttctcccggctgaacccggctattttttcactcacgagcacgacggacgcaaatgcttcatttacttcaaacaaatcaatatcgtcaacggacagtccggtttttttcaagagccggctgatggcctctcccggcgcgcttgccagctcggacgcttccagtccgactgacgcaaagccaagtattgctgcgagcggcctgacatgctgctttgctgctttttcctctgacatcagcacaaatgctccggccccgtcatttacaccgggagcatttcctgctgtaaccgttccgtcggctgtaaaaattggcttgagcgctgcgagctgctcaaggcttgtatcaggacgcagcccctcatccgcttcaacgatatgctgtttgccctttttgccgatccaggtaacggggacaatttcttcacgcaatttgcccgcctcagccgcctcagccgcgcgtttctggctcaaaagagcgtaatgatcctgttcatcccgggaaatgccgtactttttggccgcagtgcttccgtggacagccatatgtacctggtcgaacgcacaggtcagaccgtcatgaaccattaaatcctgaaaaaccccgtcccccatcctcacaccccagcggccggccggaatggcgtacggaatgttgctcatgctttccattccgcctgcaatcagcacgtccgcgtctttcgcccggatcatttgatcacagatggtaacagccctgagccctgatgcacagaccttattaatggtttcagccggaacggaccacggaagcccggcatatcttgcagcctgccgtgccggaatctgcccggcacccgcctggacgaccatccccatcaccgctccttccgcttcgctttcactgatagcggcgcgcttgattgcttcttttatggcaatgccgccaagctcggctgcctttacctcttttaatgcgccgccgaattttccgaacggcgttcttgccgcactgacgataaccgtttttcccacaattttgcctcactttcaataagataaaagataacgcttacacaaaacgccctgttacaatatatgaaccggctgaccgagttatgattgcaccgcctttttcccgcccataaaaaaagaagactgtctgaacagtcttctcagctgcggcattcttcttttatagaaacagccagctttggataatcggtaaaaattgcgtctatccccgctttcatcagctgcttcatatcctcaggacgattgacagtgaacggacggagcgccgcttggtgttttgcaagatgtttgatcacttcagcgctgaccgcaggcgtaccgagcttcggatgataacccgaagcggggatggcggcaagataccgttcaggccggtacagcacatccattgtcagcaccgcccgttcaatttcaggcgccagggcgtggcaaaccgcgagactctcatgattaaatgaagaaaaaataacgcgcttttccagtccgtaatatctgacttttttgatcacttcttcttccattccttcgtaacggaatacactgtttttcagctcaatgtttatcagaaaatcagcacgttccgcaaaacgcagcacatctgacaaaagcggaattctgacacctttaaaagaatctttccattttccggcggcatcggcggttctgattttgtcatacgccgtatctttcacaaatcctttcaaagacgtcgtgcggtcgagggtttcatcgtgaatgaccacgatccggccgtcttttgtcatctgtacatcaagttcgattccgtcagccccgtcctcaatcgcttttttgaatgcgggcatcgtattttcagggcagtcgcccgacgccccccggtgggcaaaaatattcgtcatatgtgtcacctcagatgtttgtcatcggttttctctattataatcgttatgcacatcaggagggcgctatttacacatattttatcattaccgtccgctgtaataggtttcgattccgtttacaacggcgtccgcggcatgctcttgtccgttatcgcttttcagcttgtccgcatcttgaggatttgtgataaaacctaattcagccagcacactcggcatctttgaatatgtaataacataaaaaggagcttcttttacgcctctgtccctcatccctaaagacgtgacaagctgctgctgaatgtcggaagcaagcctttcgctgtccgcgccttcatatgtcgaattaaaatacgtttccgtgcccgatgccgttgatacggctgaattcgtatggaggctgacgaataaatcggattggctggcgctcgctttcgccacccgctcgtccaaacgtaaaaaagtatcgtcagtccttgaagctacaggttttgcaccttctgcctccaatttggcgatcaccttgtttgacaccgctaaattgatgtttttctcaagcagtccatttccgccggccccgctgtcttctccgccatgtccggcatcgatataaatggttttcccttgcaaaggttcggctgcataagcggacggcgcaagcagaagcagagcggcaccgaaggcagcagcgctttttgtcagtaaacccacgttttttcctccccgttttcacatatctgtttcttttttcagtttctcaagccgtaattgtccgttgctctcttttttataggtgatttgcaccgccgtatgttcaggcagcgactgacattcaaaccgcttagcgaaaggcaccttcacctcttgcctttctccgtcaatttcgaccgcgatcgtatcgtttccggccgcttttataaatgttccttcctgtgtaaatgacggcgccgcatcagcctccgcggtatactcgcagcctgataacagccatgcggtgaagatcagaagtatgacagacttcacacagatcacctcacgttttctcattcggctttatctttgaacagattggccgatttgtaaagggagcctccattcctccagcgcttttccatatttggaatgaaggctatctgacctgctgtttacctgaacttagaaagaaaacaagctgatcagtctatgaaaaaggttctgtctgaaggccgaatatgcagaatttaacggaaacggacgactttctgttcattttgaaaaaatatcagatcggcaaaaaaaagagagccgcgtcatgcactctcccgaatagaaacattcatatttattttgagcttttcataaaatgaacgggacaacttaaaagagcagcgtattggcggcaatgatgagaataatcactccgctcagcaccgtgctgaactgtccgacgtgaaaagaaccgatgcgcaatgacgcggctttttttccaagcgagcagccgatccatatggtcagaaagcttccgatcgccgcagtgatggaaatggcagcaggagaaagcccgatcaaccccgcgcttaatccgttggtcagcgcatttgcggatacggccaccccgagaaccatggattccaatataccgatttctcccgaaccgtcggcatccgctgcctccggattttgcagcagaccggcaaaacggcctttttttcctgacgcgccaacacgcgctgtttttctcggcacagccagcagaatgatgcggataccgatgacagataaaataaacgccgccagcaatacaggaagaaagcccggtaaaacggctgaaatccatttgccgaaataaattccgatataactgaatacaaaacagataaaagcgatcatcatatttgacgcatgcgatattttgatttttctgatgccgtatgacatccccactcctaaattatcaatgcttgaggacactgccaaacctaaaatcaataaccaagccatgttcgtttctctccattctttgatgtcttttcaacatgttgtgccgttgaatctacactattctattcagcagcacagaaaaggtaccttttctgcaaaaattattgattgacgatcatcattccggcggaaacgaggtgacacccttgacagaaaataaaaataagacactgggaccccttttaaaatcactgcttgataagcactcgctctccatgagaaagctcggcgccttaacaaacattgatacggccaccatctcccggattatcaacggcaaacagaaggccaatttaaagcatcttcaggaattttcaaaacacctccgcaccccgctggaggaattgcttgaggcgtcaggcatagacatcggtcatgaaaaagaagctgcgccgcaagacccgatgcacgcgattcaggatatgctgaatatggccgagatgtttgatcagcctttttcccgggagcaaattgagcgcgaactgaccagatatgaacaatacgccaaaacccagcagggccatcgcctgatttgcgatgagtttcaaaagaaaatggacaatgaagaaagcgtcggcccttttattgatcatttgaaaaacatgcatcatcagtatatggatgaatcaacaccggctgaagaccgcgcgattctcgggagcgcgctgctgtattatattttagcgaccgacgttattccggattacatgtttccgatcggctacctggatgacgccatcgccgtgcaaatcgctttgaaccggctgaaaaaaaagtaaaggcgcttaaaaaagcgccctttttgtgttgaaaaatatgaaacaccgcattacggttttgtcaaaacagagacagctgtcatatgatacatcaacctaacaaaaaggagggtgtcttctatggacagcaacacagtagtggcagtgtgcgctctgttaagtgttgtgattcagatcggaacgatattcgccgcaggaaagtggaaaaaagaataaacaaattgacggttttttcgcacaagcgtatgcttataaataaccttgtaaaagataagaaagaagatatgcatatgaaaaaaatcattctcctcttcgccgccgctgtcatattcagctcgatcggccatcaaatttcaggaggatataaagatcctgaaaaggaacggagaaaaccgtttcattcgtttaaatggttcagccggtcataacctccggaagaagaacaagcaaaataattgcacacaatgaaaacataagctagaatacggacgagttaaactcctaaggaagaaggcgaaatgatgaagcaaacttatcaaccgctgtttgaaccttttacgttcgaaagcggcgtcaccataccaaaccgtatttcagtcgcaccgatgacacattattcatcaaatgatgacggaacgatttccgaccgtgaattaagctacattactccccgttcaaaagaaatgggcatggtcattacggcatgtgcaaacgtaacgccggacggcaaagcgtttccaggccagcccggcatctatgatgattctcacattcccggcttgaaaaaactcgctcaggcgatccagtctcaaggagcgaaagccgttgtgcagattcaccacggaggattggaatgccctcctgaactcgtgccaaacaacgacgtcgtcagtccgagcggctcagaagaagacggcagacaaacgtcccgggctctcaccgaacaagaaattgagcacatcgtgaaagcattcggcgaagcgacacgcagagcgattgaagccggctttgacggtgttgaaattcacggggcaaacgggtacctgattcaccaattttattcaccgaaaacaaaccggcgcacagaccgctggggcggaagcgatgaaaagcgcctcgcgttcccgcttgcagtcgttgacgctgtcaaacaggcgattgatacacacgctgaaaatccattcgttctcggctaccgcctgtcaccggaagagccggaaacaccggggcttacaatgaaagaaacattcatgctcgccgacgcgcttgcggaagagaacttggattatctgcatatttcactgatggatgtcaattccaaagcccgccgcggcgcggatacttcacggacccggatggatttattaaacgaacgcgtcggccataaagtgccgctgatggccgtcggttccatctataccgcggacgaagcgcttgccgtattagaaagcggaattccgctggtggctctgggacgtgtcattttgattaaccccgaatgggcggtgctggtcaaagaaggccgcgaacaggaaatcgaaaaagccattcaagcatctgaaattgagaaataccgacttcctgaaccgttatgggaaatgattcagaatacaggcggctgggtgccgtttgaaaagtagactaaaaaaactgccggatgtccggcagtttttttgattcacaagtttttaccgctttgtttactcctatttccaacacacagcgtacatatagtaaatagattaatagaaaggagaccgtatatgatggctggtttccctattacgattaacagtctttccggaaacggggttgtcaatgtcggcggtgcgttttcgataagtcatttaaccgtatcaaaaaccgtctacggctcaggagggggaaatacaggtatggtcctgcaaatgaatcaatccagcacatctcaatcttcaaactctcaatactctgatcaaaatgtaacgaaaacattatgacatccgtatttccctccctttccggctggcagcagccggattctttttgccgttttgtttaatcttattcaaatatcacagcgtacatatagttagtagactgagagagaaaggagaaaaaatagaatgagcggttgcccgattacgataaacaacgtatcaggaaacggagttgtcaatgttggcggcgccatatccatcagtccgctgactgcatcaaaaaccgttttcggtgccggagggggaaatatcggcattgtcattcaaaacaatgctgtaagccagtccaaaatgtttgaacatcaattttcagatcagaatattgtgaagtcattgtaagggctgccatgcagcccttactgcataaataaagcaggcgcatgatttcccgaaaacttgatttttaacatcagcggtcaccttctcatgttttgaatgatttcagttaaagatgaatagaatgcagattgaaagcatgagtactgaatctcattaaggaaagaaggaatcgtgatgaaaaaactttgccgggaagtttggattgaagttgaccttgatgcgataaaaaagaacgtacgggcgatccgccgccatattccgaatacgtctaaaattatggccgtcgtaaaagcgaacgcttatggccacggctctgtggaagtagcgcggcaggcactggaaagcggggcgagcgagcttgctgtcgcaagcgtcgaagagggaattgtgttacggagagcgggaattacggcacctattctcgtgctcggcttcacagctctcagctgtgtgaaaaaatctgccgtttggaacatcacattatcagcgtttcaggtcagctggatcaaaaaagcgaatcggatattggaaaaagaagcagattcgaaacggctgtccattcatatcaatgtggataccggaatgggccggctgggtgtgcgcacggaagaagatcttttagcagtggtgaaagcgctcaagtcgagtacatacctgtcatgggatggcatctttacacatttttcaacagcggatgaaccggacactgagctgacgatgctgcagcacgaaaagtttatcagcttcctccgctttttaaaaaatcaagacattacgctgcctaccgtgcatatgtgcaatacagccgccgctatcgcattcccggaattcagcgccgacatgatccgtttaggcattgggttatatggtttatatccgtccgcctcgataaaggagctgagcctcgtgaatctcacgcccgcactaagtttaaaggcgcgtatcgcttatgtgaaagccatggtgacagatccccggaccgtcagttatggtgccacatatatcgccgaaccgggtgaaatcatcgcgacgattccgatcggctatgctgacggttactcccgcgccctgtccaaccgcgggtttattctgcaccgcggcagacgggtgcaggtagcggggagagtgacaatggatatgataatggtcagtttaggtgagaatgagggcaaacaaggagaagaagtcgtcatctacggcaaacaaaaagaagccgagatttccgttgatgaaattgccgaaatgctcggtacgatcagctacgaagtcctgtcagtgttaagccgccgcatcccccgcttttatttcagagacggcaaaatcattaaaatatcagctccggtattatacgtatagacggcatagttcccgtatttatgtatagaacaagtaccagcgtgagtgattcccattgttttcgtcagcaaaatctcaaaacgccttctcttccgcgttcatgcacggaatagaaggcgcaaaaagacatttagccaaaggcttgcgttacgaagctttatgctccaatctcagcttgtcagcaaccatcgcgatgaactctgaattggttggttttgcttttgtcatgcttaccgtatatccgaacagtgaagaaatggaatcaatatttcccctgctccatgcgacttcaatggcgtggcggatggcccgttctacacggcttgcggtcgtgttgaattttttggcgatgtcgggataaaggacttttgtgatgctgccgaggagttcaatatcgttatacaccatggaaatggcttcacgcaaataaagatagcctttgatatgggcaggcacaccgatctcatggataatgcttgtaatgctggcatcgagatttttccgcttcggctccggctggctgcggataatgctgctttgcgcggacggcgcacggtgtgtgacactgctgacatttccgcttacctggcggatatggccgacaaggttttccatatcaaacggcttcaggatgaaataggacgcgcctaaatcgacggcttttttcgtaacgtcttcctgaccgaatgccgtcagcatgatgacgttcggctgcttctcgagctctgattcccgcagacgctccaaaaccgcaagtccgtccagatgcggcatgataatgtctaaaacgagcacatcgggattcttatctttaaacaaagaaagacattcctgtccgttataagcaacgccaatcacttccatatcatcctgtccctctatatattcactcaacaggcttacaagctctcgattatcatcagcaacacaaactttaattttctccacgtttcttcctcccccaatgtattaacaggacgcaacccatttgactgctatatgttacattcgacaaaaccactacttccccttttaaaaaatccatatttaccaataatagtggtatatctttgtttttctagcattttctaggtttttcgactaaaaattaagtttgacaaatcaggaaacgtgaatttgtcgaaaaatcttcatgtcttattttacatgaatccaggaaagaagtgaagaacgcatcacataaaaaaactgccggatcatccggcagtcagcttgctttgtctttcccgtaaacatcaacacccgcttcagacagcatccattcgatatgaacgccgtagccgcttgtcggatcattgacaaatacgtgggttacggctccgacgacctttccgttctgaatgatcgggcttccgctcatcccctgaacgattccgccggttcttttcagcagtttcggatctgtcactttcaacaccattccctttgtcgccgggaatttttgcggcgtggtgctgacgatttcaatatcaaatttctctactttatcgttttcgataaccgtcagcatttgcgcaggtcctttttttacttcatttgacaaagcaatcggaagcgctttgtcggaaatgttgtttttaatcggctgatgcagtgtcccaaaaatgccgaacgggctgttgcggttaatatcgccgattgttttccgttctgacgaaaaccttgccagtttttcgccgggattgccgccttttcctttttcaatcgatgttacagtagaacggacgatttctccgtcttctacaacaatcggtttttttgtatccatatcagagatgacgtggcccaatgcgccgtatttttttgttttcggttcaaaaaatgtcatggtgccgatgccggctgccgaatcgcggatataaaggccgattcgatatttcccctcggcttcgtcctttgtcggaatcagctttgttttgattttttgcttatcgcgtttcaccaataaatccaaagattcaccggttttgcccgctttttgaataaacggggcgatgtcgctcattttttcaattttatgtccgttcattttaataatgatgtcgccagattcaatacccgcttgttctcccggagactttttcccatcctttgtcatcacctggtgaaaaccgacgaccaaaacaccgactgaatgcagttttacaccgatggactgtccgcccggaatgaccttcaattctggaaggacacgcactttcgtttttttaatgggaaacccggcaagatcatatactacttctgaccggccttgtgtttgccctgttatgtttgcatgaccgtgctcttctttcagcgtaaaggcttctgataattcgcccttttcagcgcttattgatgcattgaccggaacggcctgagtctggttttcaaagacgctcatttctgacggtatcagtaaatattctttaaacggcttaaaaaagcctacacttagtaaagaaacaaggagaattacacctattgctttcctcatgttatcgtgcattcattccttcactctcctcgctcctatcccacaccactttctttttctgctacatctatacttttgccttcctgcgcttgatttataaccggcatacgaagaaaaacattggatacactgttagagaaatggaacaaaaaaataagctgcctgtatcagcagcttatcctgtcgtttttacctgtccggcctgttttaaaagctcttgtgcatgccgttttgtcagatcggtcacttcaacacccgcaatcatgcggccgatttccgctaccttatcctgcttggaaagcggcgtgacatgcgttgtcgtccgtccgtctttgaattcttttgcgatcagaaggtgtgtatccgccatggcggcaacctgcggcaggtgtgtaatgcagagcacctgtgaaccggtcgatactttatggattttttccgcgatggcttgggcaacccgcccgcttacaccggtgtccacttcgtcaaagatgatggaggtgacatcctgctgggaagaaaaaatactcttcatcgccagcatcacccttgaaagctcgcctccggaagcgacctttgacagcggttttaaaggctcaccggtgtttgttgaaattaaaaacctcacaaggtcaatccccttttgggtaagctgcacgggctgcccgttgacaaccggtgcttcactggctgacggatcggttttcacgagaaattccgtatcaaacgttgatttgcccatatacagactttgtaattcctgatgaatcgcttccgccagtttcttggcccatgcttttctgatttttgataaattggcggcttctacggccacatctttgccgaccgactccaattccttcttcagcgcttcaaggtggctgtcgcggttctcgatttgatcgatttcctcttctattttagagccgtattccaaaatgtcttctaccgtcgctccgtatttgcgcttcagctgtttgatctcatttaaacgggtttcaataaaattcagccgttccgggtcatattccagatcatctaacagattgcgcatctgaaaggttgcatcctccagcagataataggaacttgacacactttcagacagcttttgcagcggttcattaatatccgaaatatcttcaagctgggcagaggccattccgacccagtcaagccccccctgctcgctgcggagcgcattataggcgttttgcaatgattcataaattttttcaaagttggatatctgcttccgctcttcctgaagaagttcgtcttcattcaattcaagcttcgccgactcgatttcttcaagctgaaattgaatcaggtctaaccgatgcgccatttcctgctcgctttctgacagcttcttcacttttttgagcagcttcatataacgctcatagccttcatggtaagcctgaagcgcggattcggcctcagcgcccgcaaatttatccaaaagctccaagtgtttgtcgtcctccattaacagctggttatcatgctgtccgtgaatatctaataaaagtctgccgatttcccttaaagccgcaatcgtcactaattttccgttgacacggcagacgctttttcctccggcattgatgtcccttctcatgacaatcatgtcgtcagatgcgtctattccctgctcacggcatacttcaaaaacgggatgaccgctgtccaatagaaacagtccttcaagctcggcctttgtttcaccgtaacggacaaattcagacgagccgcggccgccgactaatagggaaacggcgtctataataattgacttgccggcccctgtttctcccgtcaggacggtgagcccccgttcaaacgaaatcgtcagttcctctataatggcaaagttttttattgatagttcagctaacaaacagcattccaccttttatctgataattacgctacagcagctccaaaagacggctttgtacgccttccgtatcttcaggcgtcctgcagatgattaagatcgtgtcatctccgcagatcgtgcccatgatttcttcccattcgagattatccatcagagcgccgattgcctgagcattccccggcatcgtttttaatacgatcatatggcttgctgagtcaatttttacgaacgcatccattaatgaacgcttcagttttgacagcggattgaaccgctgatccgccggcaggctgtatttgtaggagccgttgttcgtcggcacctttacgagatgcagctctttaatgtctctggagacagtcgcctgggttaccttatatccttcttctctcagcatgtcaactaagtcatcctgcgtttcaatctcatggcttgtaataagctctctgatttttatatgcctttggccttttgtcatgtaagcacctctgttttcaagctgtttgtcattatgttaaccgcttcttgataaaaagtacatgatggcagaaaaaaggaataatagccccctattattccggtacatctgtctttttggcttttaatgtctcatgtgcttcgcggacggtacggagaatgtcttcttccggcagttcagcgccgtttccgtcttctccgccccattccaaatgaagcagaaactcaatattgccgtctccccccgtaatcggtgagaaggacagtcctttcactgtatatccttcagaagctgcaaattgattcatgcggcggagaacgtcagcatgaacgccgggatctctgacaatgcctttttttccgacgaattcccgtccggcttcaaattgcggcttcaccagtgcgatacaatcgctccccggtacaagcagcgtttttaaaaccggcagaatgaggcggagtgagatgaaagaaacatcgattgtcgcaaattccggcaaaccctctgtgaaatcggaaggctcggaatagcggaaattcgtccgttccatgacgacgaccctctcgtcctgtctgagcttccaagcaagctgattatagccgacatccactgcgtaggaccgctcagctccgttttggagggcgcaatccgtgaatccccctgtagacgagccgatgtcaatcatcgttttgccttttaccgagacaggaaacacttccaaggctttttcaagctttaatccgcctctgctgacgtatttaagagggtttccttttaccgttaacggaagatcccgggcgattttttcacccggtttgtccaatcggttttcatttgagtatacgatgcccgccataatggcgcgtttcgctttttcccgcgtttccgcaaggcctttttctacaagaagtacatctaatcgttctttttttgctgtcatgatccaattcctttatgtgtcttcggcggcatcagcagttttatccggttcataacctcagccttcgtgagaccgatttcttcaagcagggcggttacgctgccgtgttcaataaaccggtctgggatgcccattctgtcaatcggtgtatgatacatgccgaggtcatgagcgtattcaagaatcgtgctgccgaatccgccttcaagcacggcttcttctatcgttaaaatcggcagaccttcattaagaatggccttcatcatttgtttatcaatcggttttatgaacctcgcattcacgacacgcacggacaggccttctttttgcagttcttcagccgcttccagcgccatttcaatggtcgtaccgaatgttaaaatgaccgcgtcttttccgggacggagcacttcccatgttccgatcggaatggttttcagctctttatccatctttacgccgagcccgtttccgcgcgggaagcgcatcgcgatcggaccttcctcataggaaagggctgtattgaccatatggcggccttcattttcatccttcggcatcattaaaacgaggttcggtatatgccgcaaaaaggcgatgtcaaagacgccttgatgcgtctccccgtcagcgccgaccaaaccggcgcggtcaatgccgataaatacattcgcgttttgacggcaaatatcatggacgacctgatcgtacgcccgctgcaaaaaggtcgaatagatcgcaagaaacggcttcatcccctgaagcgccattcccgcggccattgtcgccgcatgctgttctgcgattccgacgtcaaacatgcgctcaggaaattctttcgcaaatccttcaagcttagagccgaccggcatggccggtgtaatcgcgacaattctgtcatcctcgcgcgcaagctcctgcacggtgccgctgacaagtccgctccatgaaggcgccgcggctttcggcttgacaaaatcacccgtattgattttataaggacccgttccgtgccatgtgccgattgtgtcggtctcagccggtttatagcctttgccctttttcgtaatgacatgtaaaaggacaggacctttcgtttttttggcgtattgcaggttttcaaacagttcgtggtaggaatgaccgtcaaccgggcctaaatacgtaaagcccagctcttcaaaaaacatacctgacacaagcatatattttaagctgtcttttatccgttccgctgtggcggccaattttccgccgacggccgggatgcgcttaaataaatattcaagctcgtctttcacccattgatatttgccggccgtgcgaagccgtcccagcatagaatgaatcgccccgacattcggcgcaatgctcatctcattatcattcagaatgacgatcatatcttttttctcatcaccgatatggttcagcgcttcaagcgccattcctccggttaaagcgccgtctccgataatcgggatgatatattcttttgatcctttaatatcacgggcggcagccattcccatcgcgcctgagagcgatgttgagctgtggcctgtttcccatacgtcatgttcgctttcgctgcgtttcgggaaaccgcaaagccctttatattggcgcaaggtttcaaactccttgccgcgcccggttaacagtttatgaacataggactgatgtccgacatcccataaaaatttatctttcggactgtcaaattctttgtgaagcgcaattgtcagctcgacaaccccgaggttcggcccgatatggccgccagaggcagacagcgatgtgatgaggaaattgcggatctcctcactcagctcttccagctgttcaattgacatctttttaagaaatgacgggtcctgtattgataaaagatccaaagcggatcaactcactttcagcatgaatttctgcaaattaaacagtgtctttttgaaaaaagaaaaagactccctttgtattttcatcgaaactgcttacattttaccataggagcggcagccccttcaaatcaggaccgtttttaatgatctctcgccgcgattaaatcacagaggtcatgcagcagttctttctgaagagaaaggccgctgatgatccgtttcgcctcgctgatatgatacgccagcttctctttcgcgccttcaagcgttaaaagcgacggatacgttgacttttcattcgacgtgtctgagccgaccggtttgccgatcttctcctcatgcccttcaatatcaaggatgtcatctctgatttgaaatccgatgccgatatggctgctgaacagacgcagcttttcgacttcatcctccggcgcatctgccaaaatggcgcccgccgtcacagaaaaaccgaggagcttggccgttttccgctcgtggatggattccagctcctcaagcgttatccgcttttgttccgcttccatgtcggcagcctgcccgccgaccattccttccgttcctgccgcgctgatcagctcatcgacgagacggagccgtttttctgctgaaaccgcctcagacacgtgagatgtgatcaatttaaagctttctgtcagaagcccgtctccggccaatacggctgccgcttctccgaagactttatggtttgtgggctttccccggcgcagatcatcatcgtccatgcaaggaagatcatcatggattaaggaatacgtatgaatcatttcgacagcgcatccgaccggaatcccgtctttttcatcttttccgtaagcattcagaacggctaagacgacgagggggcgcagcctctttccgcctgcttccaaagaatacagcatagattttttgaggatttcaggcatcgcaagccgttccgtatacaaagaaagctgctgttcaatcagttgtttgcgcgatgctaaaaatgcgtccagtttatttgtcaccttcgtcttcctcctgaacgctgaaaggtgcaagttcgccgttatcttttaaaataaagtccatttgcttttcgacatgctgaagcttttcatggcacatttttgaaagggccatcccttcctgaaaataattaatcgcctgctcaagcggcacgtctccttcttcaagctttgccacaatgccttcaaggcctttcatcgcctcttcaaatgtcagctcttcactttttttggtttctgtcattttcgttcgcctctcttttgcaatacttcacacgtcagaacgccgtctgtcatctttacttcaagcgtatcattttgttccacttgatcaacgcttttgatcagctctttgtctttataggccagactgtatcctctctccatcacctgaaggggacttaatgcattcagtttaccaagaaccgtctgaaactgcgaatgaagctgcttcagctggacattcatgcttcgggcgagctgatttgagcgctcctcgtaccgttttttcgcctgtttcagctgggtttcagggtggagcgccgttaatctgtacgtattccgctccagctgcctttgtttcctgtccgtaagccctgtgagctgtgattggaactgctgatacaaaagatcaaactgctgttctttttgggtatacaatcgtttcggaaaacggaacgcgtaggatgactggagcgattgaacccgttcttttttcttgctgatatgctgctgtatcgctcttgtcaggcggacttccgccgtttttgtccgttccattaagtccgtcgtgtgggggacggcgatttctgccgctcctgtcggcgttgccgcccggatatccgcgacgaaatcactgattgtaaaatctgtttcatgtccgacggctgatataatcggaatggcggaagcaaaaatcgcccgggccacgatttcttcgttaaatgcccacaattcttcgatcgagccccctccccttccgacgatcaggacgtcacacattttttgtgcattggcttcttcaatgcgcttcacaatcgatctgctggcattttcaccttgaacgagcgcgggaagcacaatgactttcacaagggggtatcttcttttaagtgtggtaatgacgtctctgacggctgctcccgtcggtgacgtgacgaccccgatcgtagccggaaaagcggggatggcctgcttatgccggtcatcaaacaacccttcgccggcaagttttttctttaattcttcatatgctaagtagagcgcccccacaccgtccggctgcatttctttcgcgtacagctgatagcttccgctcggttcatagacggagatcccgcctcttacgatgaccttcattccgtcctcgggcttaaacgcaagcctcgaactttgtctttgaaacatgacggcctgcatgcgggcatgctcatcttttaatgtaaaatagatgtggcctctcgtatgaattttaacattggagagctcacccttaatccaaatgtcttcaagatgagggtccacatcgaattttcgtttaatgtatttggtcagcgcggaaaccgtgacatatgccgcttcactcacatcctgcactcctttcataaaggctttttgccctaaactaagaaaacccgctctggctgaaaggagccttaagaagcgggtatcgtgctcattgtcacactttttgtgactgtctccggttatctatgataacgtacgtctggcagatttaacagtattatgcgcaagcattgtgatggtcatcggacctactccgcccggcaccggtgtaatgaaagatgctttttctttcgcttcatcaaactgaacgtctccgcagagttttccgctttcgagacggttgacgccgacatcaatgacaatggcgccctctttgatttgatcggctttgatgaaattcgctttaccgaccgctaccacaagaatatctgcttttttcgtatgctcagacatatttttcgtgcgggaatggcaatatgtgacggtcgcgttttcgttcagcagcagctggccgaccggtttaccgacaatattgcttcgtccgactacaacaacttctttgccggaaagatctacgttcgtctttttcaataactcgacaattccgtgcggcgtgcatggaagaaatgtatcttcgccaagcagcattttcccgacgttgagagggtggaaaccgtcaacatccttatcgggagagatccgctcgattacggctttttcagaaatatgatccggaagcggcagctggacgagaatgccgtggaattccggattttgattatactgatcaatcactgttaaaagctccgcctcggttaagcttgagtcaaagcggtcaagcttaaatttcattcccattgtttcagcggcttttttcttgcctgtcacatatgaaacagaagcgggatcgtctccgattaaaatgaccgccaaaccaggcactacgccttgtgctttcagctcttctacttcttttgccaattgttcgcgtttttctttagccgtttcttttccgtcgatgattgttgcagtcattttctttcctcctatgattcgatatcagttttaatgttagaaagaaccccgtttacgaattttgcagctttatcgtcgccgaaccgttttgccagctcgattgcttcgtttaatgacacgttagcaggaatgtcgtcagtataaaccatttcatacaccgccagacgcaggatcgcgcggtctacgtttgcaatccggtcaagcttccaattgacgagatggccggaaatcatttcatcaagctgaacctgatgttcgatcactccgtacaccagctgttcaaagaaggcatctgttttttcaccatcaagcgcgtgctcaatggcatcgttcggtgcaatatcgctgacatcaatctgaaaaagtgcctgcaaagctttttctctagctgttcttcttttcattttctttctccttcagatccgctttatccgcttgtcgttaagcttaaagagatcataacatatttttttctcaatcgcatgtcgaaatttaggttttttcaccctaatgccgaatattttcacaaaccgtattaatttcattcggatttcacagcatgaagaaactcggctgccgtttgtaagccggctttcttcatgcctgaaatgacgggaaacgtataaaaaaccaaagggctgcccatccccttggtttttatacgctcattacatttcttcgtcgatttcgacttcttgggctttcgtgtcaaattgaatgccgacgatatgaatattgatttcattaatggtcagagacgtcatgtttaataaggtttggcggatattctcctgaacgcttgccgccactttcgggatcgagatcccgaattgaacgacgcaatagacgtcgatggtaatgccgtcatcggctaaatcgacctttacgcctttaccgtgattgattttgccgaagcgctctacgacgccggtggcgaaattgccgcgcatttcagcaactccttcaacttcggaagcggcgatgccggcaatgacttcaatgacctcaggagcaatttcaaccttgcctaaatgagcctcgtcatgatccattttaagcacactgttgtcttccattcaattcacctcccgcaaaaattatgagcccattacatcatatgtttctaaaaactttgtattaaactctccgctgacaaatgtttcgtgttcaagcagtttcagatggaacggaatcgtcgtttcaataccttcaatcacgaattcgctcagcgcgcgtttcatccgtgcgactgcctcatcacgcgttgttccgtatgtgatgactttagcaatcatactgtcatagtacggcgggatcgaatagccaggatatgcggctgaatccacgcgtacgccgagtccgcccggcggcaggtacatgttaattttaccgggtgaaggcatgaagtttttcgcaggattttcagcattgatgcggcattcaatcgcccagccgttaaattcaacgtcttcctgtctgagcgaaagctcctgtccggatgccactttgatctgttctttgatcagatccgttcccgtcaccatttctgtgacagggtgctctacttgaatacgcgtgttcatttccatgaagtagtagcgctgttctctgtagtcataaatgaattctactgtgccggctcccgtgtaaccgacggccttcgctgcttttaccgcagcttcgcccatctgctccctgatttcagaatcaagcgcaggtgacggtgactcttcaagaagtttttgcagacgtctttggatagaacagtcacgctctccgagatggatcgtgtttccgtaattatccgcaagcacctgaatttcaacatggcggaaatcttctatgtacttctcgatgtacacacccggatttccgaatgccgtagcggcttcctgctgggtaatctcaatgcctttgatcagttcttcttctgtgcgtgcgacccggatgccttttccgcctccgcccgcagtggcttttataatgacaggatacccaatttcacctgcaagcgaaaccgcttcttccgtattttttataattccttttgaaccgggcacaatcggcacgccggccagctgcatcgtgtcgcgcgcgatatcttttgttcccatttttgaaatggcgtcagccgtagggccgacaaacgttacgttcaattcctcgcacagctcggcaaagtcggcgttttcagctaaaaacccgtatcccggatgaatcgcatccgtgccggtcagctttgcgacgctgacgatgttcgttacatttaaatagctttcttttgatgttttcggcccgatacaaaaagcctcatcggccatttggacatgcagggcatctttatctgcctcagaataaacggctacagtttcaatgcccagctctttgcaggcccggatgattctgacggcgatttctcctcggttggcgatcaatagctttttaatcataatagcaggtctccttactcagcttttacaagaaatagaggttgtccgtattcgaccagctggccgttttcaactaacacttcaacgatttctccttttacttcggcttcaatctcgttaaagagtttcattgcttctacgatacaaacaactgtattttcgctcacttttgaaccttggtttacgtaagggccggcttccggcgatgaagaagcataaaacgttccgaccatcggagacgtaattttgtgcaggttttcgtcttgtttcggcgcttcctgaacaggagcggcttcacgcgcttccggttttgcagcctgcggagcaggtgcgtaagcggcgggaacggcttgggcttgtcccgttacattcactgccggcgcttcattttttttcagtttgaggcttacgccttcgatttcgtaaacgaattcgtcgatggaagattcatcgattctttttatcagttcatgaatttcgttgatttttaacatcagtttccactcctatgtataaaaaatagaaatttatgggttgctactaaaagtacatactatgtttatcttacaggagcgcttgtgtaaattcaatactgatctaaaatgacatcagaaaagcccgcagcaggtgcgggcggtggagatctcttattttgtcggttcaaacgtgacggcgacgtctttcatcgtcttgatttctttttccaccaggtcaatgatagcggaagcttttgcgtttgaatgtttgtcagacatgaccgtaatgttgattttgtctccttcagcatccacgagcgcatctttgtagccttgtgttttaatcagcgtttccagctgtttttccgtcccttcagcattgctcagcgccgtcattttatcgtaggcttcgcttttttcctttgcggtcgcatcatcgcttgaaacaatgctgtttaactgttccctttctttgcttcttgcgtcttcaagctccatgcggtatgcggtaaataagttttcatcagctgtttctgtagcgaccgatccgtctttgtccgatgcttcggctgatgtttctttatcctcttttgtgcctttagaatctttcgttccttttgttccgtcttctttatccgtgccgcttccgttcttatctttcgtttcaggagccggcgttttttcagttgccacttctccgctgcttttttcgcttttcatctgcacggcatttttgctttccggcgacataatataataaacacttaataccacgacgagactgagcattgttaaaagccaaaccgtttgttttttcagcatgatttatgaatcctccttgatttttttaggggcaaccgctacacggtagctcggaacatcaagcacccttgtgacggcatcaatgatggttttttttatttgaacgttgtccactccctgagcgacaacgagtacaccgcgaatatcgggctttttcgtctggacgacgaccggggtttccttatccccgtttcgaatcatgacaatttgctcctctgaggtttgatcggttacgcttcttttgccgccttctttatcggtttcttcggtggtggtgtcttttttcgttttatttttctcaaacactttcaaagatgttgcgtctacgttcacgacaattgatacatcctccacgccgataatcgtttcaaggatttctttcagctggttttcatagtctctttcataatcatcgatcgtgtttttggcgctgctgtctttcgatgccttaaaaacgggtgcgcttttttgcccgcttttgtcttccgttcggccggacatgacggtctgcgccgcttggtccttcccggttttctccggtgaagagaacagctggctcaccagcataaaagataccccgagcacaaacacgaacagaaagtaatgatattttgtcagttttggtttttctccgtctttcgcctgtccgatcatcagctgttttttgagtatggtccatagtccgtttttattcatggccgtttttctccccgccttccatataaaccgtaattttctcactgccgatttcccatatatccgcaagtttttctttgatgtctgcggcctcttttttgtcggctgcgccttccggttcgtatttgcggtctgtgcggatgtcgatcggtgcgacggtttgcacggttttttcagaagatggggccatatacacgctgatcgttcttacatcttcttctgaacgaacctgttcttccgctgtaaggcggatgtcgtctattttgtattcgtcatgactgaacatctcctccgctttcttttttagttggacagccatttcttctaaaacatatgcgcggtttgatgcttgtatttcttttttttctgatttgatttgattttttatatcagcggattgagattgctcttgttttgtcaaataatcgaagatgatttccgggtctgttttgaaaagtttgaagatcgggttgagcatgacaatgattaacagcaggctgacaaccatcttggcgtatttttgcatactggagcttggcagcagcatgtcgatgacgatggcgaataagataaataaaataatgcttgtcagccattctgttaaaaagctcatatccaatgggcctcctttatttcatcatcatggtgaggttgcctgctgtaataatgactgtaatactgaggaaaaacatgagagagacgatggcgagcgccgcgaaaatatacagcacgcttctgctgatgacgccgaggcacgtaatgacgggcccgcctccgagcggctgcagaatagcggccgcgagcttataaataaaagcgagcgagagcactttaatcgccggaaacgcggagatgcagatcaaaattccgactcctaggattcctacggtgttttttaataggagcgaggcgctgatgaccgtatccgtcgcatccgtaaacatccggccgagcacgggaataaaattgcctgtgataaattttgcagtcctgagggtaatcccgtccgtcacggcagccgaagccccctgtacggagatgacgccgagaaacacggtgagaaatacggcaagcgcgccgatcgcgatatttctgagcagattggcaagctgcgtgactttatattgatccgtcatcgtgctgacgatgcttaaaatcgctgacaggaagataagcggcatgacaatgttttgaatgagaaggccgctcgtattcatcagaaataaaataacggggtgaaaaaaagctgcggagacggctcccccggaagacgccaaaagcgcgagtaaaagcgggatgagcgcgagaatgaaacttgtcatcgtctggatcgcttcactggcataattgacggcaacatgaaagctgtttaaagcgagaataatcagcaccatgtagacaattgcataagccactttgctgacggtgctctgctggaacgcattttgcaaaagctgcagaatgacacaaaaaatggtgagaagaatcaaagttcccaggagctttccgtttgcgagcacttcatgaaacaagtatgaaaataaagccttcagccatgcctccggcgagaacgttttttctccgttaataaagtcgatgatgcttcccttttggctttcaggcagaagaccgccgtattctgtcatgatgtcgtcccaaaactttccgatgccttctgttttcagcgcttcagcctgctttttcgccacttcatcagcggattcttggtgaactgcggtttcctgcgacgcaccgtctgttccggcagcttgtacacattcagtctgaaaaaataagaggatgaacaaaaaagcccccgcccaccgaaagcgcttcattttttgtgcccccctttccattttattgatgatcaagaaggaataagtccgagaatcgtttcaataatgacggtgagtatcggcacggccattaccagtatcaaaatttttccggccagctctattttcgaagcaatcgctccctggcccgcatcctttgtcagctgcgcaccgaattcagcgatgtaggcgatgccgataatttttaaaatggtttccacatagaccatattgacatttgcattgacggctattttttctatcattctgataatgtcgtaaatctgatcgatgagatagagaaagatcacgcagccgctgaagacgacaatcataaacgcgaaagtcggtttctgttctttcacgatcagggagagaaatgtggcgatcaggcctaaacctacaatttgaacaatctcaatctgtaagcccccctatccttggaatagaaacacagctttgatctttttgaacaggtcatcgacaatcgtcgccaccataaataaaatatagataaagccaagcagcgtcacccattgggcgtattctttttttcccatttggtcaagtatggtgtgcagaaacgcaaccacgataccgactccggcgatttgaaaaatgacatttacgtcgactcccattttatgtttgctcccctcatgtttacatcaatagaagaatgagtaacagtccggctaaaaatcctaagcttttcaccattttttcatttttcgcctgcgcccgtccggcatccgcttccgccgcttccaaatgtgtaagcgcaagcttgatatgtttctgctgagaaacacggtcatggagcccgagcgtctctccgaattgcttcagcacatcgtattcgctttttttcatcgccatggaagaccagttatgtttcaagctctgttcccaagccgttttggcggaatcgcttccctgctcaagccttctgctgaaagctagaaacaataacgatacaggttcggaaagctgtgcggcaatttgtcccgaagctatgtgcagcggcgtatgcccgaacatgatttccgcttctagcgattggagcgccgcgcgcagctgacggatctgcctcggcctttcaatatacattttggcgatctcaaatcccgtccatgtcgtcgctgtcagaatgaacacggcacctaaaagcttcagcatgacatcacgctttcagcatgcggaacaggtttcccgtcctttccgtaaatcctgctgatcgttcccggaccgcggcgtcttgacagctccacataccggtcaaacacgttttcctcccacagcattttcagcgacggcctcttgaccaagtctttcatattccatccgtgcgcagagacgataacggatacgcccgcatggagcgcctccagcagcgcttgtgagtcttccattctgccgatctcatccacaattatgacatcaggactcatagagcggatcatcatcatcagcccttccgccttcggacaggcatcaaggacatcgactctgcggccgaaactgtgctggggaatgccccgcaggcagccggcaatttccgaccgttcatctacgatacctgtcttttttgccgggatgcgtgttgatccggtgctggaaagccgggccaaatcacgaagcaaggtcgttttccccgtttgcggaggaccgatgatcagcgtgttcagccagttttctttccataagaaaggaatgagcggttctgcgatccccagcttctcccgggcgattcggatattaaaagatgtaatatcccggagtcctttgacggctccgttttcgacgatgactcttccggccagccccacacggtggcctcctctgattgtgatgtatccttttttcagctcttcttcaagcgtgtacatactgtagttgctgagccggctgaggatcagctgtgcgtcgccggccgtacacacatatgacaaatacaaaggttgtcctttttggatcagttcaaccggcctgtcgacccggattctgatttcttctgtatcccgccttacttcttcgggcacggcggagatggcatctctcaataattcagggagaacctctgtaatttcattcaatagagtctcctcctttttaccgattggcttctttaaaatgtatgatccgggacagactttatgacaccctggccctctatttatgcacaccggccaaaatcagcaccacccccgcaaaaatcaatattaattttgcatatgagagctgtccggcaatctgataaatgccgatcgtcattgtgatgataaagatcagagggccgacgattgccaaaatactattcaccacaaccgcttttctgatgtcgtttgtcaaaagcatgataatagcggccgataattcaatgagcgaggacaaaactcgtaaaccggccatcgttaaaacagtagaattgattgaaccgaacaaaattttcattgcaatcccccaacttcaagcattttgttacactatatgctctagctgacggaagtagtctcactattttcatatagaagaaagattctgaggcagaacgcaaaaaaagcctgccccgtaaaaggagcagactccgaatttctttaactacgctcttgacacgtaagaaccgtctgatgtatttacaaccagcgtatcgccttcgttcacgaagaacggtacgtttacgacaaggcctgtttccgttttggcaggtttcgtgccgcctgacgccgtgtcgcctttaattcccggctctgtttcaacaactttcagttcaactgtgttcggcagttcaataccgagcgtttcagactgatacatcatgatatgcacagacatattttccagaaggtatttcaattcttcttcgatttggttttcgttcaattcaagctgttcatatgagcttgtatccatgaacacgtgctgatcgccgttggcataaagatactgcatcgtttttgtttcgatttgagctttcgcgactttttcacctgcacggaatgttttctcctgaatagcgcccgtgcgcaggttacgcaatttagaacggacaaatgccgctccttttcccggttttacgtgctgaaagtcaacgacgcgccaaatgccgccgtctacttcaatcgttagtcctgtacgaaaatcgttaactgaaatcatgtttgatgtcctcctatattccgatcacaaaataattaattctttaggggaatgcgtaattgtccggttgccgtcctcagtgatgaggatatcatcttcgattcttgcgcccccaacatccggtatgtatatgcccggctcaaccgttaccgccatgcccggctcaagaacggccgatgacctgaaagacagccccggtgattcatggacttccattccgaacccgtgtcctgtcgaatggccgaaatactgtccgtagccttttgcggtgatatgatccctcgtcagggcatccgcttcttttcccgtcatgccgggttttatatgcaggacaccaagcgcttgggcatcgtatacgacctgataaatctctttcagtttatcacttggctctccgaccgcgacggtgcgtgtgatatcagaacaatagcctttataataagcgccgaaatcaagcgtgaccaagtctcccttttcaatcaatttgccgcttgccactccgtggggaaggctggatctgactcccgaggcgacgatcatatcaaaggaagagccgtctgctccttgacgtctcatataaaattcgagctcgtttgcaactgaaatctctgagatgcccggtttgataaacgtcagaatatgttcaaacgcatcatccgcaatcttcgcagcttcctctaatatcttaatctcttcacttgacttaatcaagcgcaacttttcaacggaatccgcgacgggaaccatctccgcttcctgcagcaccgcttggtaggatgcatatgttccgtacgtcatgctgttttgctcgaagccgagttttttaacgccgtactcaagaatcgtatccgcagccgtttggattaagctaccgccgtgctcgataatgtcaaaacccttcacttgcgtcttcgcctgctcggtgtaacggaaatccgtgataaatgccgcacgttctttcgatatgaccgcaaggcctgacgaacccgtaaatcccgtcatatactgcagattggcggagcttgtcaccaacattccgtctatatccagctgaccgaaaagatttcgcaatttctccagtttcattccctttctcctcctcgccgattcttgactgccgcctgacaacgcgggagcatccccgcccggttttcagcataaaaaatgttcacttctcgtgaacattttaccataccggatagggattatacacttattcacttgttgccgagcgcccttgcaagcttgtctgacgtaagttcattgtagttgaaggaaattgagtagccgacaaacaaaccgtacagaatgtaaaggcaaagcgtcgtcacgattgtatctgatttcaattcagtgacggatttcacatcttcgaaaatcggattgaataagaaaaaaaccgcacaccataaaatgacgccgtacaccatccccggccacatggttttaaaacgcttcaggcagacgaaataaataaacgccccggcaattgaaatgaatccgatgacaacgatgctgaccatcgtgcctagccattgttttttccattctccgatcataaacggctgaagaatcatgttggggctgatctctgaaaaatgaaagacatacccgagatagccgatcaaactccaaaatacaccgccggcaaatccgataccgcaaattctgccggtaaatgaaacaggctgctgatcatcatcctgcttctttttttcttcctgttctgaatgtttttcgcttgtcatcatggcacctccagtcatagactgcccaaaaattaaaaagtcataaaaagctgcgccatattttcattcaatgagtaaaatctaaagaaacggggtatactgcatgtagaaaaagcattgattttccggctgtctaactagaggtttaccgcggtttcctgtacaatagagtgaaaggaaatggttagtaaatcctaagaaaacaggcaggttgataaacaatgtccaaacaaaaaacgccccctgcatacggcgggcaggctgtcgttgaaggggtaatgttcggcggcagaaaaaattatgttaccgccatccgcaggaatgacggaagcattgattttttcaagcttccgagagtgccgaacgccaagctttcggctttaaaaaagattccttttttgcggggaatcgtcgccatcattgaggcgagcgccaacggcacaaagcatttaaacttttccagcgaacgttacgggcttgatcctcaggatgacgccaagctggagcaggaagataagaagggttccggcttatcgatgtttttcagcctggcggtgatcggcgttctgtcgtttttgttcagcaaattcgtttttacgctcgtcccggtcttcttagcggagcttgtaaggcccgtattttcctcagacgccgcgcagatcggaatcgaaagtctgtttaagctgattctgcttctcggctacatttattttttatcaatgacgccgttaattaaaagagtgtttcaatatcatggagccgaacataaggtcataaactgttatgaacagaatttgccaattacaatagaaaatgttcagaaacagtcacggcttcattaccgttgcggttcaagctttattttatttacgatcattgtcggcatgttcgtctatttacttgttccgacagatccgctttgggtgcggattttagacaggattgcgcttataccggtcgttctcggcatctcctttgaagtgctccagctgacgaacagagtgcggaatatccccgttttgaaagtgctcggttatcccggcctgtggctgcagcttttaacgacaaaggaaccggcggatgatcaggtcgaggttgccatagaaagctttaacgagcttctcagactggaagacatttcagaacagagcgaaaagccgtctcacaacgtaatctgagccgttaccgttattattttggaggtgggcagttatgaatcatcgtgtacaacctttttttgctgtattgatagcgcttggcgcattcggtttcatttatgcggcggtaaccaaccccgggcagatgatttcaagagcgatcaccgttattatcgcaggcgttattatttattttatcgtgaggacggtcctgaaccgccgcaccggccgtgacggaaccgctttcagaaaagcggccagacaatcgcggctccgaatgaaggagcaaaaagcgaagcaccgcgccggacacagaggccgggtcagccatttgcggagcgtgccgagcagtagcagaccgaagccgatgattcttaagaaaaaaagccagacccagcttaccgtcatagaaggcaaaaagaataaaaagaaaaacagagcgcttttttaatagctccattgcttcaaaaattgctctgttctgctttttcctagctcaatgagagctagttttttttgcggtgtgagatgaaactccgtcgccatcacatgttccaccggaataaaaataatattctgttcgtactttgtcgcgatatgcctggcatcatgagcgtctttcatcgtttcaaacaaagccccgaacagctcaaaagcgttgcggattgattttttcgggcgctctttttcgttgggcgaaagcgaaattccgatgaccggccgtttgcgttcttttgaatacagccaaatcgggaaattgcttaacacaccgccgtcaacgaccgttgaggtgcctttttcggtcttcagttttatcggttcaaaaaaataaggaatgctgcagctcattctgacggctctggcaaccgggaacatctccggatttaatccgtagcggggaagatcgtcaggaagcacgatcatcgttccgttcgtcagatctgaagcgatgagacggagcgagccttttttcaaatcgccgaacgcgatgatgcccttcgcttttaatttatccgcaatccatttttccagcatatcgcctctgtatagtccgaggcgccaatatatcgacacccactgcaggattttcagcgggaggaatgagcatctctgatcaagcaattgccttccgtccacctcatctatgatggaatgaacctctctgctcgtatagcccgcagcgataaatgcggcaataatcgcgccggcgcttgttccggcgagcctttcaaagcgaaagcccttttcttccagcgcttcataagcgccggcaagcgccaccccttttatcccccctcccgaaaatacgccgtcaatctgcatagcgcgccctctcccttccatctcaaggtgtattattattttaagaaacggctgggcgaaatagaccaaagaatgaagacattaaaaaaagggcgccccatttcgggctgccctttattcaccgggattttcggtttttttctgtacggatttcaattcttttttccggctttcgtcatcttcaaaatactgaacgaggtcgccgatgcggtcaatgctgttccagctcagatgatgttcgattccttcaacatcattgtaaatcttctcttcatcaacaccaatgattcttaaaaactgctcaagcaattcgtgtctgtatacgagccgtttgccgatctttttgccttttgacgtcaatacgagcccgcgatatttttcataaatcaaatactcgtctttatctagtttttgaaccattttcgttacagaggaggggtggactgccaaagcttccgcgatatcagaaacccgtgcatatcctttttcttctatcagcatataaatctgttcaatataatcttccatacttggtgttgtcataagtaaccctcccaaaaagcaccttaactttataaaccattacaagtttacactaacggtcatgaaaaaacaaggatgcttccggtctgtcaagccttatcagcgcttataattccattcatcagacgcgtatttcgtctcagccagctcattgacaaatgcaagctcttcagacgtgagtgtgtaaggctcaagatgaatgttcagcccttcctcaaaaccggctttaaaagcgattctggcctcatccatcgttacccgtttcggcgctaaggcgttgatggctaccgctttgtttttgaaattccgctgcatgcgctcacggactctgtcgctcggatataaaaacagatcaaacagtttatcctcatcaatgtcaagcaggatggaaccgtgctgaagaatgacgcctttttggcgtgtctgtgcgcttccggcaactttccgtccttcgacgaccagttcataccacgaaggcgcatcaaagcagacggacgagcgcggatttttcaagctttctttttctttctccgttcgcggaatcgcaaagcaggcatcaagtccaaggtttctgaatccctgcagaataccttctgaaatcacccggtacgcctctgtcaccgtggccggcatttccgggtgatcctctgaaacgattacgctgtatgtcaattctttatcatgcagaacaccccgtccgcctgtcggtcttctgacaaacccgaggccgtgtttatgtactgcgtcaaagttaatttccttcttaatattttgaaaatacccgacagacaaagttgccggattccagccgtaaaatcggatcaccggaggaattttcttttggctgtgccaatataaaagcgcttcatccagcgccatgttaaatgccgggctttcattccctgagtcaataaaccgccatgtttctttttccatatactgaacccttctttatcgttttaataaaatcagtttagcaaactgccttgaaaatgaaaaatatttcgtttcattaaggatgacaatcgcttcatgctttactataatagtatttgtcccaaaacgtccggtaagccttgttttcaggaagcagggttttgattttataagctaaaggagtagaattgcattgtctaatatgattgctttaattattgttgcggcgtttatcgtttatatgatcgtgtcgtatttttaccagcagcgtttaatgaaaacacttacggaagaggaattccgcgcgggctacagaaaagcgcagctgattgacgtccgtgaaccgaatgaatttgaaggcggccatattctcggcgcgcgcaacattccgctgtcacagctgaaacagcgcaaaagtgaaatccgtcctgataaacccgtttatctgtactgccaaaacaatgtccgcagcggacgcgcggcacagacgctccgcaaacacggctgcaaagatatttacaacctgaaaggcggatttaaaaaatggggcggaaaaattaaagcaaaaaactaatcatgaaaaaagagctgtccgttttatacggaagctctttttttataccgtgtcagcggctgacgtcaggtgtacgttcgtattttaaaaccggctttcttgccgccttggtttcatccattcttttgacaactgttgtatgcggcgcctcctgaacgatttcaggcgattcctccgcttcccgcgcaatttgaatcatggcatctataaacgcatcaagcgtttccttcgattccgtttccgtcggttcgatcatgatgctttcttcaacattgagaggaaaatacacagtcggcggatgatagccgaaatccaaaagccgtttggcaatatcaagcgttcttacgccgagctttttctgccttcttcccgataacacaaattcatgcttgcaatgacggtcaaacgggagatcataataaggcgcgagtcttctcatcatataatttgcatttaaaaccgcgttttcggtcacagcttttaagccgtcaggccccatggaacggatatacgtgtaggctctgacattaatgccgaagttgccgtaataaggttttacgcgcccgatcgactgcggccggtcatagtcaaaagtcaaacggccctcttttttcgtaagaacgggtttcggcagatacggaatgaattcttttttcactccgaccggccctgagcccggtcctcccccgccgtgcggcccggtaaatgttttatgcagattaaggtgaacgacgtcaaatcccatatctcccggtcttgctttacttaaaacggcatttaaattcgctccgtcataataaagctttccgccggcctgatggacgatgtcagccatttccgtaatgttttcttcaaacaacccgagggtgttcggattcgtcagcatcagcgccgctgtttcttcgtttaccgctcttttcaaatcttcaatgtcaaccagcccgtgctcatttgacttaacggtaatcgtttcaaaaccggcgaccgtggcggatgccggattcgtaccgtgggctgaatcagggacaatcaccttcgtccgtccgaagtctccccgcgcttcgtgataggcgcggatcatcatcaggccggtccattcgccgtgagcgcccgccgcaggctgcagcgtcacctcgtccatgcccgtaatctcctccaagtgtccgcttaaatcgtataaaagctcaagcgccccctgaactgtgtcctcgtcctgaagcggatgaatagcggaaaaacctgcgaaccgggcaattttttcatttaatttcggattgtatttcatcgtacaggagccgagcggataaaagcctgaatcaactccgtggtttctcttagaaagagcggtataatgccgcataatatcaagctctgatacttccggcagctttgcgtcttcatcgcggatatagtcaccgggaagaaggctttcaagctctgtttccggcacatcaagctccggaaggctgtaaccgacacgcccttcgcgggacatttcaaaaataagcgcctgatcttgattattcatgttgatcccccaatcccgcaataagcgaatcgatctcttctttcgttctcagctctgtgacggcaatcagcatatgctgattcagttccggatacgcaagacctaagtcatatccgccgatgatgccgtcttgcaggagccgccggtttgcttccttgacgggaagattcagcctgacggcaaattcattaaatatcgggccgtcaaatgctacgtgcaagccggctttttccgcttggcgtctcgcgtaatcagctttcaatatattttgacgggccatgtctttgacgccgttttttccgagcgccgtcattgcgactgaagccgctaaagcattcagcgcctgatttgaacaaatgttagacgtggctttgtctcttctgatatgctgctcgcgcgcctgaagagtgagaacaaaacctcttcgcccgttttcatcctccgtttggccgacaagccggcccggcacctttctcatcagttttttcgttactgcaaaatagccgcagtgcgggccgccgaatgccgcaggtatgccgaaaggctgcgcgtccccgacgacaatatcagctccgtatgccccgggcggtgtcaaaataccgagcgcgagcgggtttgaagaaacaatcagctggctgtttcctttatgtgcgagcggctcaatgccctttaacggctcgatttgtccgaagaagttcggatactgaacgatcacggcggccgtctcatcacaaacggcatgttccaatgcttcaagatctgtgacgccgtttttcgcgggcacctctacaacctcaatatattggccctttgcgtatgttttcaaaacatcccgtgattccggatgaacggctgcggaaatgacgatttttttctttttcgtatgtcccgatgcaagcatcgccgcttccgcaagcgccgttcccccgtcgtacatagaggagtttgcgatatccattcccgttaattcacagatcatcgtttgaaattcaaaaatcgcctgcagctccccttgtgagatttcaggctggtaaggcgtataagccgtgtaaaactctgatcgggaaatcacatgatcgacgataaccggctgatagtgatcgtacactcctgcgcccagaaaagatgcatatgtaacagcgtctttatttttcgccgcaagctttgtcagctctctcgtcagctccgtttcagattttgcttgtttaatttggtagtctttttgaaacctcacatcttccggaatatcggcaaacagttcatcaattgtttctgcgccgatggctttcagcatttcttttttatcctgttctgtcgcgggcaaatatcgatgcttcatatgactctcctttttcagttctgttttggacgtttataaaacggtgtgcggacaaccttcgcttttaccgtttttttacggatttccacttctacttccgttccgacttcactgaattccgttttgattaaggcaaggccgatatttttctttaaagtcggagattgcgtgcctgtcgtgacttccccgatcggaacaccgtcttttttcacggcgtacccgtgtctcggaatccctttttcaatcatctcaagtccgaccagctttcgcggggctcctttttctttctgttcacgcaatacagatttcccgaaaaaatcggaatctttcttgtgtttcacggcaaatccgattccggcttcaatcggtgtaatatctttcgtcaattcctgaccgtataaagcaagcttcgcttcaaatctcagcgtatcacgggcgccgaggccgcacggaacgaggccttcatgctctcccgctgcaagtatctccttaaatagatgaaccgcatcttcattgcggcaatataactcaaacccgtcttcaccggtatagcctgttcttgaaagcaggacttggcgtccggcaacgtccgcctcgtcaataaatgtaaacggctttaaggaggacaaatcacattcagtcagcttcgcaagaaccgtctgagcattcggcccctgaacggcaagcagtgaaatcccgtcagactgattcgtcagcgtgacgtcgccttccgcatgttccgtcagccaggcgatgtctttttcaatattagacgcgtttatcacgagcagatagcagcgctcgcttttctgatagatcagcaaatcatcaaccgtaccgccgtcaggataacacatggcggtataaagcgcgtttcccggctttaaatcggcaacgtcatttgtcatcattttttgcagaaaagacagggcgtctttaccggatacttcaacttcccccatatgagacacatcaaacagtcccgcttttgtgcggacggcttcatgctcctctttaatagaagaaaattgaaccggcagctcccatcctccaaaatcaatcgtttttccgccgtattctttatacacgtcataaagcggtgttcgtttcagcatcatcttccccttcagtcattggcgcattgtaaaaacatataaaaaaggacagagaaacacctcatgaaaatgaaggtttctctgtcccggcacctgaaagtttactttatgaacatatcataaagacgtcccctttggtggcctgcttcttctaagtgcagacactctccagagttgcgtcgagcaagagttcttttgcctgagagattcactccgcagtttgctccttcggcgcccggacgcccatctttcgtccgagtctctccccttgctgtcattcgctcatatttaccaattttatggacatactaaagcaatatcttttagtgaaatcattacttatatcctaccaccctcatttacgtccggcaacaaaaattatgataaatcagttttttaaaagaaaggcggttttgttacatatgacagcagagatcatatttgatgcaaactggccgggagagttttctgagcggctgaaaacggacggtccctggtcaaattgggagatgtacaaactgtcggctgaagtccagcagacccttgccattcctgaattcgaagggttgagggctcctttgtaccttcccgatttcactccgcttccccatcagcttgaggtcgcgcagaaagtcgttgaaaaaatgaacggcaaggcgattttggctgatgaagtggggctcggaaaaacggtggaagcaggcctgattttaaaagaatatatgattcgcgggctggccaaaaaaatcctgattcttgtgccggcatcactcgtttcccagtgggtgaaagagcttcaggagaagtttttaatacccgctgttgaacagaagaaaagctatgtgtgggaacagtgcgatatcgtcgtttcttctattgatacggccaaacgctcccctcacaaagacattgtcctttctattccgtatgatctcgtcattattgacgaggcgcacaagctcaaaaacagcaaaacgaaaaattatgaatttgcgagaagtcttgtgaagaaatactgcctgcttctgacggcgacgccgattcaaaaccggatcgaagaaatcttcaatttagtgtcactgttaaagcccggccatttaggaaacgaaagcggatttcaagaaaccttcaatcagaaggacgggattgacgctcatgagcatttgaaagaactcgtcaataaggtgatgatccgcaacacgcggagcgacaccggccttacatggacgaagcgccacgtggaaacagtgccgatcaccttttcaccgacggaacaggcgctttacgatgacattgccgcactgaaaaacggcacggaaaagcccgcaagcgcattttccattatgacgctgcaaagagagtgctgttcaagcagggaagccgtgtatatgacgctcaaaaaaatgcttgaccaaaaagacaaacaagcgcccgcattcgatgaacagacgatcgctaatttaatggaccgcatcaatcaagtcacgcaaaactcaaaagcgattcaagttgttgacttgatccaaaagattaatgacaaagtcattatttttactgaatacagggcgacacagatttacctgcaatggttccttcagcagaacggcataagctccgttccgttcagaggcggatttaaacgcggaaaaaaagactggatgaaggatctcttccgcggcaaagtgcaggtgctgattgctacagaagcaggaggcgaagggatcaacctgcaattctgcaaccatattatcaattatgacctcccgtggaacccgatgcggcttgaacaaagaatcggaaggattcacagactcggtcaggaaagagatgtccatatctacaatatggcgacaaaacatacggtggaagagcatatcttaaaacttctgtatgacaaaattcatttatttgaaaatgtcgtcggagaattagatgacattttaacaaaaatcaaagtgagcaattttgaagaccatttgcatgatattttatgccattcgctgacagaggaggaaatgagaatcaaaatggacaatctcacctcttttctgtcgtacagtacggaaaagcccgccacaaaaaaaggctcttaaaaaggaggaagcgcgacatgagacagcaggaggttcaccaatttttactgcgcttttttgaagcgaaccactgcccgattacagaacacgggccgggttttatgacggttcagttgacggtcgagatggacaaacaaattatgaaccgcccgttttattggcattggcgtgaaaaaacgggcggcgaaccgaacccgatgaagattacgttcatcactgataaagaaacggctccggaggatatggacggcgagtttatttactttggagccccgcgcctctttcaaatctttcaagcagttaaacaaaatgggagatttacaagaatatatgagaaaattgtatcagccggagccagagtgccgcttcagccctggcttggattaaatgtagtgatttcataccaatccgacatgaaaaaagacagacttttgtctttaggcctgcatcttgtttctggaacaattatagaagggtttcagcagaagcttgcaccgcttccgctgacctcgcaaatatcagactattgctttaccatatcgccgatgattaagccggaaagcgggattaaaaggatggagcattacttaaaagacgctgccgccaaagagccgtcagactgggctgacagcgcgatcgccagatggaaaaaggacctcaggcttctcgatcagttttatgagcagacagaagaaaaacctgaggaataccatttggaaaaacaagcgctgaaagccttatatcagccgaaaattcacattcagattgaaaatggcggtttatttttcctgcaaagtaatttttctggataagcgttatccattcgacacctttcccgttttttctggaaattctatattataataaaagtatatagaaaaaatttctggcgtttcgcatgcgatgaatcacttccagacatgtaaagataaggtcatgggcggattggctgaaatacataaacaagtattttaggaggagaaaatgcatgaaaaatgcaaaaatggaattttcgcaattagataaggaatgggttgagctgatattagaagctcaaaaagcaaatatcagcctagaagaaatacgcaaatacctgctttcgcataaaaagtcttctcaacatatccaggcagccagaagtcataccgtaaatcctttctgaatgtgctataatatcacaaggaaggtgatgacattgattggccagcgtattaaacaataccgaaaagaaaaaggctactcactatcagaactagctgaaaaagctggggtagcgaagtcttatttaagctcaatagaacgaaatttacagacgaacccctccattcaatttctcgaaaaagtctccgctgttctggacgtctcggttcatactttacttgatgaaaaacatgaaaccgaatacgatggtcaattagatagtgaatgggagaaattagttcgcgatgcgatgacatccggggtatcaaaaaacaatttcgtgaatttttagattatcaaaaatggagaaaagcgcaaaaagaggagtagtgccgccatatgtgcacaactcctcttttaactgtccgactttcggattagtttttatcctcactgtgagccttttcattttccttgacgtaaccgtctttatccgtatgatctttcgtaatggtcaagccgttccattgcgttgcttcaaaagagaattgaagagaaatcgcattgccttggaacttgttttgcacacttaatccgtccgcagtttttgcggtgtcatttttaaattggatttccattctcacctggtcataatcagcaggcgttttcggaactccgtcgtactcaggagctgttttgccgttaatggttgccacattgacttttccgctctcactcaggaatttcggatcaatgtgcttgctgatcgcttcggcagctgctttatcctgttttgttgacattaagtataagtctttcaggctggccgcctttaaaatgatatttttaggatagccgttgcccccttctttaccgactgtcagaaccgtaatttcaaactggctgaggaaatcctccgcagattcatttcctttctttgctcctttaaagtcagtaaaattcaaagccatcagcacttctttaatggcaagtgaaccgttgtttctgaattcaaaatctttcgtcaatttatcacctggttttaagtttgacaaattgacattggctgattgttctttagccgataaatcaagtgttcctgacgcaaatgtagcgtccgtcgactttacatcattaaatgcggcccatgtgcctcctcctactaatgctaaaccgagtgcggcagaggcaacgcccaagcttaatttctttttcatacccatgtttgtactccccttactttttattttttgttatcaaatcctgtcgccaggttgcaaccgtattcatgtggagatggttccctttttcgcatgttcttccagcgctttcgttttccgctcaatatcgcggagggcgctgacgatgactgttattgagtaaatcaaaagcatgacgccgggaacgattaacagaatcgccgttccgatcggctggcttgccaaatgtatgacatatcctgcatacggaagctgatatcccgtatactgggccgccactttttcagcttgaacgggtgcggcatccggggcggcattatggtccccttttgtctcaaacagcaggttcccgtccttttttgtgatcccgattattctgtgtgtgacggctgttccgtcatcttgcgtaaaggtgatcacatcccctttttttaagtcattcacgtcagaaattttctttaccgctatgagcgaacccgtcttaaattccgggtccattgaacccgacagcacggatttcagcgtatagccgaagatggccggctcacccccggaagcccgggtcgaaatcaccgttaacgtcagcacaataatcagactgaagatgacggcatacaaaatattactgatcagtttcagcgtttttttcatgttcttccccgctttcttttaccggctcagccggctctttctccgttttctttagatcagaaacggttgcctgttcccggcatttgacgagtttcatcggttttgaccactcaaatttttcttcgtccgccggatacccttcaggcttgtaaaccttgaatgcgtatatgcccggctgcaaagaccgctttgactcaattttataaatcgttttgctttttttatcagtaataagccctttatccacaacattgccgtttcgtaaaggctgctgctgagaagcgattttatggagctcccatttccagtcagaaacagtccgctcttttcccttattctccagctcggcatagagttgaagcggcgcacacacggtgcctgacgtatcagtttgatttgttatatgtaaatcactctgatcccagcgttcgtcataacggcaatcgtcatccgtatattgaaaatctccgcacgtttgaaccgggagactgaagcttttcacatcattgaaggaggaacttgtatcacctgtgaactgagcacatatcgtcacggacaggcaaaaaatgaacgaaagccgtaaaaatagcatcatccgccatctcaccttgccctttttttccattcgcaaccatcggaacatgccttaccccctgtaaaactgttaataaatatgacaaccgttctttttaaagaaccgcatgaacaaagtataatcaaggattatcgtcttgaaaaatgtcaaaatcggtcaaattgttcgtttttaagaatggtatctttcaaaaacatcgttttgcttcaaattacacacctttttggaattttttctaataaaacgtgagaaaataacgaggtgactagaacaaaatggaaagtatatacagcgaaaggacgaagaatgatgatcacacaaagtctgatttgcctttctcttcttgttttcggggtttcaggaacagctcaggcggaaacggtgccttattatgctgttcaccataaatcaaaatgggaaaagttagcagaaaaagaagctaaaaaaaggtatccgctcgcccaaacattatttattcaaaaggtgtgggatcggaaaagaacggatgaagcagtcaaacaataccacttgacattgcgggatggcgcaaaagaatttggtgtgtttgttacgatttcttttaatccctacagccaaaaggtaaataaaattgccgtcattgaggaataccaataagaccctcctgatacaggaggacctttcgtgtgattcactttatttttttcgttgcatccacagcttaaaactgtacggcaatattccgaaccagtgctgagaagccggcactttcttttctttccgcacttcttttcgctctctccgttcctgtttcggcgtatcgaaatatttaacgaattgctcagtcatatattttacataatcatttgttttcacggctctcacctcatagtgctgtctttactatgaagtgttgtctcgccgcctcttttttatacttccgtccattgaatcagctgtttcttcttctgatcgaacaaaaggtgagcctcgcgtctcgtgcctgacactgtttcggcctgaattgtaacctgaaccgtttcccggcgatcactcccggtgatgtggaaggaaacagttccgtacggaaaacgctgtgtaccagtttggaccttttgtccctgtgtcatatggcggcttgacagcagcgcgccgttttggagcagattctctccgatccagtactccccggcctctttctcaaatatttttcgggtgatgaaatcagatgaagtatagctgatgacaagtaaaactgcggcagaaacaaacagaatcgcgggatatataaaaccgtcagatttgtgcatttaatcaccttttaaagagctgtaaaccggaatgaccgcctgattctttttacctgtaacgcttgagatctctaataagagcaggccgtttttcacatcagccgttaatgatgccgtgttttgcaggatcggcacgtggccttttccgtttactcttttccttatcatcttatgataaatttcaaaacgcacttcttcgccccctgttttccggcatgctaacgccaatccgccgtccgccggcttcacagtctcagcctgtttacattcgttcatgatctgctgaacggcaatttgatgctcccggctgtctaatccgccgttatcggtccggtttgataaaaacagatgtaaaatcgggcccagggttcctgataggaaaagacagactgccaaggagaacaaaacattaagaagcgtaaagccagtctgttttgagaatgctgaggcacatttctttttcgccgcggtcagccgcacacactttgtaatactcaccatcctccttccacttcacaccgggagacggcggcttttttccggtcatcatataagtgctgatatgtttctgaagaagctggtacgcttcctggcgatcttctattttcagaccatctgtcagcatgcccgtccagaccggaatgatagacgtcataaggaacagccaaatggacattgctgatagtgtttcaatagtagagaaccctttatttccgtttagcatggacatttccgctccctaagtaaactgtgatctcataggtgaacccggcgctcttcaattgaatctttcctcccgaattcggatggcctttttcattaaattcaaggctctccggtaaagtcacaagtgtaatgtgaagcgaatcaaaagaacgttcgacaatccttccgcctgactgcagtttgtatttatgctcttttggtagaaaagtgatttttgttcttttatgttctgcgatagccgtttcctgcgcaagctgaatatctttttgaagctgttctgttttttgccgcacggcaaggtgggtgcagaccggcggaaccgtcgtgaacaaaatcgtcagcaggacggacgccaggcttaacacaatcaggctttcaagaagggtaaacccgttttctgtctgcctgttattgttcaactgtaacttctccgccactaattaagatctgtttaccattcgggcaggctgtattctttttgatatacccctctgattgtaaatcgttcatatccggcattttaccttcatggtcgatttcgtacgccgtcacttgggctttcaccatattctgcagtccttcacagcctttatgctgaatgctttgattatgttttgtaacgttaggaatggtgattaaaagcagaatggaaacgataaataaaacgatcagcatttcaattaaagtaaatccatcttgatttttcagacgaagcactcccttacatttggttcatcatctggtacatcggcatcagcattgacatgtagacaattaaaatcataccggccacaacaccgtaaatgacaggctggagaatgccggtatacttcgccgcgttttgttcaagacgctccatcataaactggctgtacgtataaagttcgcggtgaagcaggccgtttgcctgtccgtggctgactgcagccgcaagatctttttcataacacggatgcccggaaagagcggattctatggtttctccggctttcagacgtgtaatgagcatctctgcttcttcacgataaaaaggcagaaaagattgttctttaaaagctgttaagctgtcatagatagaaaggccggatttcagaagactgctgagctgtaaagagaaaaagtagctgttaaaaagaacggccgcttttcctaagaggggtattttcacaacaatgagcattttatcttgcggggattttttcttacataagaaccaaacgtacaaaaacaagcagaaagcggcggacagcgccagtgcgcaggcttcatgaaaatgccgaaaaaacgcaaagatgaaagcagtcgcaccggatgtattcatattcattgattgataaatcccagaaaactgcggaataattaaactttgcaggatataaaacatgacacagacggaagaaattaaaaacatcggataccggagcatttttttgatttgattcgtctgcatgagctttctctgtaataattcgccgctttgtttcatcgcccctggcaattctccgtgtttctctgcgaaatagcagatagagacggcttctttatgaaaagacagtgcctcaagcacttcgtaaaacgcatcaccttccctcagccggcggattccgtccgtcagctctgcaagctgacgtttatgcagctggagtttcagcagtctgagcccttcaatcagactgtatcctttttccgtcatttcaccgagccttttcaaaaaagccgcttgatccttcaacggccaggttcgtttaatccgcttcatgatacacccaccgatcgtaattgtcggtcgtgacatagccgagcgcgattccttttctgatcagcctgcggagcgtctgatattgaaaattggcgtgctctccctttgcttcccgaaagcattgggtgaggtttttcccgtagagcagttcataaatgcccgcacggcgtgtctgcctgtacatccggcagtacaccgaacagttttcctctttgcagaacggacatgttaaatcaaccagacgctgagcagcgatggcaatgacggtttgttcaatttctgtcatgttcaccccaaactccagcagtctgtatatggcgcccttagcatcccttgtgtgcaggcttgaaagaacgaggtgtcccgtcatggccgcgcggactgcgatttcagccgtctcggcatccctgatttcccctaagatgatcatatcgggatcatgtcttaaaatcgcttttaaaccggcggaatatgtgactccggctttttcattcacctgaacttgcaacacatcctcatctcttgtttctacggggtcttcaagcgtgacaatccgccggttgaaatgcctttttgcatagttgacaagcgagtaaagggtggtcgtttttccagatccggtcggtccggtaaacagaagcaggccgtgcgaatgcttcagaaaggacaatagtgcggcgcccgccccccgaaataaagacagtttatccagagggggaatctgccgcttaggcaaaagcctgatgacaagactttcatcattcattgtcggcaaggttgacattctcaaatgaacggtttccgtcggaagcggcagagacaatgacccgttttgcggcttacgtctttctcctatatccatggccgataaaaacttgaaatgagaaataagccttacgcattcctctttttttaagactctttttttcacaagagcatggccgatgcgaaaatgaatgaaagcatccttttctctcggcacaatgtgtatatctgaagcccttgccgtataggcctcgtttatgatgttcctgctgtatgtttcaatatttttcacaagactttcctccttccgcacgtattgtaaatcagatacacaaaagccggcaaaggagagattatgcgttttacactgtgtaaaacgtaaaaaaataaaaaataagccccctgactttgatttactgaatgaaatccggaaccattcggccattttcagccatcaaaaaagcaggcgtatgcctgctcttcttagcgtttcttttctttccgcaaatattttttttgatgctccctcaaaatgtctcctgtccagcctttctgccgcagataaatataaatcagcagggttgatacaataatgagcacgatggaacagatatacgcatatttccaatgaagctccggcatgttatcaaagttcatcccccagagagctccaagcgcggtcatcggtgtaaagagagttgtaaagatcgtcaaggctttcacaatttcatttcctctttgggaggtaatgacttcctcggcgtgcagcagattgctcagttcctgatcaaactcattgatatatgtaatccctctttccatcttatgatgagccctgaggtaatctttctgcctgtcatttttcgggagaaacgcttcttttaaagccatttccacttttttagctcccagtgtaagacctttccaaatgaacagctcatggcgcagtttatgcacattttccaagattcctttgctgttgtcatcatgaatctgccatttcagcgtccgctgcttgacttcaaattcatccagtccgatcagataggaattcatcagctctcccagcagaacaaaaaagccttcaatcggattttcacaggtttgaatctgctgtgtggcatgcttttcttttacaccgcgcagcagcgaaaaatcaaaattaatcgtaaaaaagaagtctctcgtaatataaaagtgaaatacggtatggtttttttcatcatctaatccttgatgatagattaaagatccgaaaaccgcttcattattctgatcatttgtatctgagcgcagaaagtttatatgattttcatgttcaaaccacttttcgcattgcggccagtgattgtgatgaatcatttttttcgcttccgttttttcatgcggaccgagctggtaccacagccagtccgctcccgaatgtaccttcatctcttgtcatcctccagtatcgctttcttgttttattaccgtaaatgaagcaggctaaaccaggttcgatgtttgagcagctttctacagtggtattattccgaaaaaagggaggtgcaagccttccttcgcggaaggcgttacattgtatatcatcaaactatctgccatcgtactatttattttattaacggcgtgttttgtcgccatagagttttcaattgttaaagcaaggcgctcccgcattaatcagctcattgaggaagatgtaaaaggagcaaaagcagccaagcatgtcattacacacctcgatgaatatttatcggcgtgccaattgggcatcaccgtcaccgctttggggatcggctggctgggtgaaccgacagtcaaaacaatgcttcagccgttatttttaaaaaccggagttcacgaagcggttgcccaagtactgtcattgatcatcgcctttctgctggttacatatgtgaatgtcgtcatcggcgaactcgccccgaaaagttttgctatccaaaaagccgagcggattacacttttatctgccagaccgatgattttgttttataagttaatgtttccattcatctggctgctcaatcattccgcccgcctgattacagccatgttcggcttgaagcctgcttccgaacatgaaatggcttatacggaagaggaattgcgggtgctccttgccgaaagctatcgaagcggcatgatcaaaaaaagcgagctgcattacgtaaataacatttttacatttgataagcgcactgccaaagaaattatggtgccccggaatgaaatggtgagcctgccgttagacagcggatcgggacatatgctccgggacattatcaaaacaaataaatatacccggtatcccgtcgtaaaaggagataaagatcatgtagtcggcatcatcaatattaaagaagttttattcagattcctgtcagaaggaggggcgtttacaaaacacgaactcagcccttacatccagccggcgatccacgtgattgagacgattccgatttatcaattgttcgttaaaatgcagcgagaacacgcccatatggccattctcattgatgagtacggcggaaccgcgggattagtaacggcggaagatatcattgaagagatcgtcggcgaaatccgcgacgaatttgatacggacgaaacaccttccgttcaaaagcttgggaagaaccgctatctcctgaacgccaaattgctgatcagtgacgtcaatgatttactcggaacagagattacggctgatcaagtcgatacactcgggggctggtttcttactcagcatattgacgcgaagcccgggagcaccattgattttgaaggctacacatttacggtaaaagaaatcgacagccatcatatcatgacgattgaagctgacaaagctgaatagctgagggagaaatcctccccggccattcagctttttatcatcttaatgattcttttacgataaatccgttttttgccagcgccttcgccagactctgctctgttttcacctgagaaaaatcgatgccgagcttcacgacagtctgcgcgatttccggtctgatgcctgagattgtcgtttctatgccaagaagttttgtgctgtcaatcactttgaaaatctgataagcgaccatcgtatccacaatcggcactcctgatatatctaaaaataaataagaaagacggagtgaagaacattggtcaagcaccgattccaaaatcatttttgcccggtaggtatcaatttcgccgacgagcggcaaaattccaataccgtcggcaatcggcataatcggcgcgcttagttcgttaatcatttccttttgggcgtttaattgtgtaaccgtcactttataatattcctctgtaaatacttcaatcatatggtcaattgctttgttcagcttctctccccaatggaataccgcattcgccccgggcttctcagacatcgtttcacagcatgtctgtatgcggttccagaccaatctccggaattctttaaagctcgtgacgctttcatagaccggtacttcatggacggcccggtcccttgcgaactgaagcgcccactttgtcagctcctcttccccgccgtctttttccgataaaatgccggcaacgatttcaattaacagacggtgctgcatttccgctttctgatcatctgaaggccgccccgattttggtatgagcagccactggcgtgtgatttcacctgattcttcaattaaggttcgagataatgtttcattcaaatgtttcacgggtctcctccattcaaattactttgtatgtataaatcggcgccggacgcacatactgtaattacatccgatgggctatagccaagcggtaaggcaatggactttgactccgtgatcgttggttcgaatccagctagcccagtcccgcaaccgcaaaaaacgaagattagctgataaatttgatcagcggatcttcgtttttctcttatgatacagattgatgtaccgtttttttcttcgtcagcttcatcagttctcccggattgtatccgataacgagcttattgcgatcgatcagaatcggacgccgcagcagtttcggcttctcagtcaaaagcttcagcacttcatttacagtcatttcttcaatgttcaggttgaggtttttaaatgtttggcttctcgtcgccaatatttcatcaattccttcggtcgttaatgataagatctgcttcaattcatcaattgtcggtgtctccctgaatagatggcgctcttgaaagtcaacattgtgggcttttagccaatgtttcgtttttcggcatgatgtgcagctcgggtatgaataaaaaataagttctttcatttttaaaaattcctccctcggataatccgtctctttgttaacataagtaccctgaactttttttccctaaacgtatttcaaaaagatttttcggatcttttttagagagcggcataagatataaaacacagggaaagacataaattccacaataaatataatcatgaaaatgtttacattttgagtgccgatctattataataaacttcagatagactctcgggaggggataaggaatgaatcgcatgttccgggtgttaggattttggacggggatatttgcagtcatgttttttctagggggcatgaaagacgcttctcttttgttttttggacagacgatctttttcgtatttctttcttatttgaatctgactgagcggatgtatatttatatttttggagcttacttaaccgtatttttcgccggatttacatattactctatttttattatgacaccgggcggcggaacccattgaacagaaaaagacagaccgattatggtctgtcttttttcatttacagtgaaaaaccattgataaacgggtttcgctcctgctctgtctggatgtccgtttccggcccgtgcccgcttaatacaagtgtatgtccgggaagcgtgagcagtttttgatgaatggaatcaagcaatacgtcctgacttccgccgtgtaaatcagttcggccgatgcctccctgaaagagcacatcacctgaaatcaccagatccgcgtccttcacataataagaaacgcttcccggtgaatgtcccggcgtaaacaatgtctccaaatggaaaggcccgatgtccaaaatgccgtcgccttcgatgagccgttcggcgggccgtgccgttacggcaatgccccgcaatatgcctgatccgtttaaggaagagtcctccagccacttttcttcatttttgtgaagatagacgggaacatcccatctgtctcttacttcgtcaagtgcgccgatatggtcaaaatgggcgtgcgtcagtaagatggccagcggcttcagattgttttcttttatgtaattgttgattttgtccgcttccccgcccggatcaaaaataagacaggactgatcctcactgacaagaaaatacgcgtttgcctgaatcggaccggccggcattcgtctccatttcactttcatcacctctttatgtatatgcccttattatgaaggttttctgcggaagattcaatgaatgcggatgggaaaacgctatcgacaaataaaatgaaaacggttaaaataaaatggaaagattttcaggttccaatgacaaaggaggagcatgatgttactagttgtaatcttcggccttgtcgcattattagctgtattaggagtcctgcgggctgtcagacagagaaatatcctgggatttttgttagccgccgccacgctgggtgtgtttggctggtttaccgtaatgaccgttgtaaccagcggctatccgactgcacattaaaagcctgtatccaatggatacaggcttattttttattgctgcaaatgtttgctgacacttttgattttgctctccagcgtcgtttctttatcacgtctgtcatcaatgcggatatttgtcgccactctgtgcagccctttttggaacggggcttcgtgaatgtcctgaatgactgcgaataagtcgctcagctcaccttcaatcaacgtgttcatcggcgtgagctgaaatttgattttgccggcagctttgtaaccctccaaaatgttttgcacatccgctacatactcactgacgctcggtgtttttgttccgatcggaatgattgtgacatctgcaattgccatttggttcaaactcctttttcatttgttatgattggttctgtcatgcctgttttcagtgaaatcagacggtcatacgtaaagccgtataaagcgtattccccgttcggagagatctgaatcggctccatttccgtgtttttgagcaccgtccgctcccgttcgtctcctaagtcaaagctgatcagattgtaagagcggccttcaggcttaaatatgtaaaaccgcttgtgtgtctgatcgtaatcatattccatcggcgcaaagctctcatactttttttggagaggaaagcggtgtgtcacggatgccggcttttggaaaaggaactcgccgtctccgtccgattgatccgtttgtctgacggcaatcgtcatgcccgggcgggaatcagcccagatgacgtgatgaagcactcttttttcttttttcgtctgcaagtcataagaatataaaggaccctcttcctccgtttttccttgcttgatatattggaattcatcagtggaggtccaatgaacaaaaggggcctgaacgggactcttttttaaaatgccgttgttcatatcggccgtataggctgtgaagtcccatgtttcagtaaaaacggtaatcatcatttgatacgggtcatacggattccaagccgtctccagctcataagagttaaaggctttgtgataaagtcttttcccctgcttgttcataagcacaagctcagtctgaccgctgcttgtcacctgtacgagaatcagctgttttttccggctgatctttacattgacaatattgccctttgtttcatagagccgttcggattttccgctgaaaagatcatatttcatcagctgatgatgtgctgtatacagaattgttctgttatccagccatccttccgttttttccgcttcctttttactgagcggaacgattttctgttctgccgattttgccgaaacgcctgtgtcttgctgctgatgagatggttcacaggccgctaaacacagaacgaatgcggacagcagaacacaaaccaagtatctcatcagccttccctccattcttttctattgtcccatatttgtttatgtaaacaaatgagaaatttcacagatgtctcaaaaaacaagcgacctccacaaaataccttccgtcgcttgataaatatcagcaaactggtgaaaaggcaaagggttttttcccttcccgagctcaatggtatagccctcttttccatactgctgtataaaccaatccctaaaaccggcatggctgtcaatggttttaacgccttgatagcggtttccgcttatcgcttcaaactcccgaatcatctgagatgattgctccggttcacatccttcgtatccccagtaaatctcttctccctgcgtatgaagcgcgatcagccggtcaggcggctgatccgttatcagccgatgcatcgcctgcgcctccggttcagtgagcggcgccgttcccggaaaatcacggtatgaaggggctttcggtttgcgcctttgttcaatatcccaattggatgggaaatgtttatttaaatccacaccgtttatattcgccttccattcgcggaaatccgagcggtgctcatttaattcgttgagaaattcatttttttctgataaatcttcacatccgtaaagcacgagatcaaccccgtcgggatttacgagcggaacgaatgacaatgatgtccggctgaatatatcaagcgcagagtgcccgaaaacggttttattttcgcataatgccgcgcaatattctttacaccatttaagcgcgaccgaggtggtgatccattcattggcatgaaatgaggcgtttacatggacttttctttcggccgtatccgcacctattttcagctcataaagcggctttcccaatacggaactgccgattttacggcatgtgacaaacggaaagacatccgttattttctcaatttcttcataaaccgattgggagccgtacaccttttcttccttcacccattgatcagcggaaagaacgctttcacagtgccggatgtatcgcgaaagcccgctcagcgtctcaagcggcggaccctctgactgcccgctcacggcaaagccgggacaaaataattcatcgctttccgccattttatcagcggctttcaacagtttttcatcaattgaaagcacctttgcaatatctttcatatgctgtttcaattcaggtttgacacgaattcccgccatgttcatccccctttttttaaaactatatgacaggggagataaaaaaagaaagctgcccgcgatatgggcaggcagactttcttcagcagttttgatgtttgagccattcatttttggcaatccacgccccgccgatgactccggcgtcatttccaagtgccgcaatcgaaatatcggccgcttccgcagaacgcgggaacgcggtgattttgaaggtctcttccacttttgaccgcaggatttcacccgctttagacacgcctccgccgagcacgattttcgtcggattcatggcgcttgccagatttccgagcacgaggcctaaatgttttgcgacgtaatcaacgacttcaagcgctgtcttatcctgctgtttagccgcttcgaacacgtcacgtgccgtcagatcgcgcacttttaagagcgaagagtcggaaaccgctgcaagcttttctttcgcgatgcggacgatgccggttgcggacgcaatcgtttcgatgcagccggattttccgcaattgcacggagctcctccttccggaatactgcaaatatgaccgatttctccgccggccccgtttttaccgtgaacgatttctccgttgacgatgatgcctccgccgactccggttccgagcgtcactaaaatgacatctttggccccgtcacctgcacccttccacatttctccgagcgccgcgatattggcatcgttttcaatgacggccggaatacccgtttccgcctcgagatggtctttcagcggatagtttttccaccccatatttgtcgtctcatagaccattcccgtcgccatttccacgggtccgggcgctcccattccgatccattttacgatccgtttcggcttgttcagttcttccagcttctgatcaagcgctttggcgatcgtgaccgtaattgtgtttcctgatttatcggtcggaacttcccatttatgctgaatttcaccgtacatgttgataaaggccagcttgatggtcgttccgccaagatcaatccccgcaaaccatgtatcttccataataatctccttttcttatttaaaatcctgctgtgttatctgtctttgatccgctccgattctctctgaagaactccggcggctttttgccataattctctttcaatcacgtttgacaagtacatttcctttaattcatctttcataaagtcaatttcggcttgtctgtcaccgaaataaacgatatgtccgaatgacttaaacagctgctgcacgtcataaaatgaattcatcttcttcaccatttctattcttcttagtataagcgtatttcatcactgatccgggcgtcaagcaaaaaacgattggagaaaatatccttgtattattttcataaattgtatattcacaattgtaaaaaaacactcatttatgcgtttttctgttacaatactttcgtgcccaaaagcacaaaaggattaaagtttgatggggtgttgttttgaaacaagaaaaaaggctgacgttcatctcagccatcagtttatttgtcttgatgttagcagtcattatttcctgcctgtttttctttcatacagagccgcatatgccgctgttcttttgcgtcattattctgtctctggcaggtttatggctcggtttctcgtgggacagtcttgaaaaaggaattgtcagcggattgaaaaacggtgtgcagccgattatcgtgctggctttgatcggtgtgctgatcggcgcctggatgtacagcggcgccattcccactgtcaccgtttacgctttgtcaattatacagccgagtcagctgcttttgactgcattattttcctgcatgattatcagcacgcttgtcggctcaagtctgacaactgtcagtacaatcggcgtcgcgctgttaggggtagcaagcgcggcgggagttccgctcgaatggacggcgggagcagtcatttgcggagcttgtttcggtgataaaatgtcaccgatgtccgacacgacgaattttgccgccggaatcggcgaaattccgatttttaagcatattcgccatatgatgggcaccaccgttccggcactgctgatcacgatcgttcttttttatattctcggttcatctgtttcaataaatgccgcttcaacgcaaaatattgaggcggtcatttccggaataaaagaggccgtgcacgttacgccttggtcgcttctttcacctctgttggtgatcattttagctgtgagacgggtttccgtgattccggtgcttaccgccggtattatttccgcagggcttctgactgctgtttttattcctgacagcagcattcaaggatttatatccgccctgcaaagcgggacggcgtttaaaaccggcgaccaggctgtggccagcattatcaacagaggcgggctccaatcgatgatgggatcagtctctctgatcatgatcgcctttgcgctcggcggcctgatggaaaaaacgggcctgatcgcggcgctgcttcaaggattgataaaaggcgtgcatacgaaaggacgtcttgtcatggcgaccgtcttctcaagtataggcgtaaaccttgcgacaggtgagcagtatttgtcgatcttaattccgggtcaatcttataaacctttatatgacaagctcagtattaagcggattcaccttgcgcggtcgcttgaggacggcggaacattgatcaacccgctgattccctggggagtaagcggcgcttttatggcaagcgcattaggggtttccgtcatcgactacctgccgtttacctttttcctgtacatttctcctatgatctcaattctgctcggtttcctgaaaaaaagctgacaatacgagaaaacctgccgttttttaccggcaggttttcttatgcaaaaaatcccgctgaaaaaacgggatttgtttaaaatgcctgctgaatgaatttgtttctgataaacggtatttttaaaaagaaatgaatgaatgtccgtctgatccccggctggctgagcacgctgttcatcagacggtagcggttttggtaaacggctaaaacagatacggcgcataatgagtagatcaacaattttttcatcttatccctcctgcccctatcgtttgtcaaacagcgagaattattccggtgcaagaagttttttatgcgattaagcgatggtttcagattcagtcacgatcatatcgaccggaatatcgtggggcatgcggggaatgcggtctgtcagctggcagtcaaagagaagcgacacggtacggcctttataaccggacaggtaccgatcataatatcctccgccgtatccgattctgaagccttcccggtcaaaagccacgccgggcacaatcacaaggtcaatgtcattttgggcggctttttccgtcagactctcgatcggttcactgaggcccgcatatacggtttccagctgatcatacgcagaaaatgtacggaactccattgctcccgtctgcggaaagcattttgggatacagacttgttttttctcttgccaggcctgttcaataatcggccgtgtcggaatttccaggcgtgtcgagatggtaacggcgatcacgcgggcctgtttccattcttttaaagaaaacagcgtttcacgcatgctgcggcattttttctcccattcactttctgtcatgtcagaaagctttgcttttatatcggttctgatttgtgctttcacgtttctcaaacctccctgaaagacaaaaaagccagaactttattgaaagctccagctttttccgctgtgttaaacagcttattttgtttcacggtgtaacgtagattttttatcacgtgggcaatattttttaaattcaacgcggtccggattgttgcgtttgttctttttagaaatatagttacgctcaccacattcagtgcaagccaaagtaatattaacgcgcattattttccctccaaactaaatatcatttacttattcagacttatatataataccactataatggacggaatgctagagctgatttacatgaaatgttgtttaagtgcagaaaacatcagtttacgcttctgatcctctgaatgagcttgcgtcagaagaaggcaaaatatgacgaaacaggacaaaaaagggctttccgatacgaaatctatagagaaataaccgtttgctccccgagtaaaaaagattttccgacaaaattccgtttttttctctatttcctttagaatggcggcgttttatggtataaaaaagaagggcaaattaataatagaaggtgatgaaacgtggaaattgctattattgcgttgtttatcgtcagtatagcgcttattgcattctcatattctcaaagagatccgatgaaagacgtggaacaggagctagaaacgcttcagctttccgccatgcaggaaatttacaagttgaaaaagaaaatgacggtgcttgaagaagaattgctggaaaccaacctcgtgatccgcaaagccaaaagcagcggcattaaccaaaaaatcgccaaacaaatcatttcaaaatataacaacggaatgtctgcggaagccatcgcaaaagcggagcacgtgtctgtcgaggacgtcaataccattattaaagataatgagaaggtgctcgtatgacaaaacggggcattcaggcttttgcagcaggcatgattttagcgacggccgttctcgccgctgtcttctatttgactgaccatgaccaggcagccgccgttaaaaccgaaaaaacagcattgacagaaaaagaagtaaacagctacctcgacgatcagcacaaagtctccgtcaaccgggatgactatcaaaaactgcttgattctaaagaaaaatcattaaacaacgaccaaaacatagacgctaaaaagaaaaaagtaacatacaaactgacgattaaagacggaatgagcactgctgatgtgtcatccattcttgaaaaagaagggattattccttcagcgaaagacttcaatgattacgtcattgacgcaggctaccacaaagaaatccgtgccggccatttcaaagtcgactcagatatgagctttaaaaaaatcgtcaaaacattaacccgctaaaaaagcttgcaggcatcgtccattcagatggatacggccggcaggcttttttaataggcatataaaaaggacccggtcaatggccgggcccgtttttttatccgaattttccggtgatataatcatgtgttttttgatgatccggctgacaaaatatttttcctgtatcgccccactccaccagttcgcccatatagaaaaacgcggtttgatcagagaccctcgcagcctgctgcatgttatgagtcacaatgacgattgtatacttttctttcaatatcaaaatcagctcttctattttccgcgtggacacgggatcaagagcggacgtcggttcatccatcagaaggacgtccggtttggtggcgagcgcccttgcgatgcacaggcgctgctgctgaccgcctgacagtgaaagcgcctgctggtgaaggcgatccttcacttcatcccagagcgcagctgcttttaaagattcctcagcgatttcaagcagtttctttttatttttttcgccgtgaattctcggaccgtacacgacattctcaaatattgactggggaaacggattgcctttttgaaacaccataccgatctgttttcttaattctgccgcatccgtcttttccttcagcagattgcgcccgttatagatcatgtcgcctgtcactttgacattcggagccatttgcagcattaaatttaatgttttaataaaagtggatttcccgcagccggacggaccgatgatcgcagttaccttccgctcctcaaaaccgatcgtaatgtcttttaaagcctgatgggctccgtaccatacgttcatgccgtgaatatcaaataaattctgtgtgtgcaccgcttccttcacaagtctcacagtccttccccctatccgaactttccgttaatgtagtcatctgtcttttgcgctttaggactcgtaaaaatttgttctgtctgcccgtattccaccacttccccgtttaaaaagaaagccgttcggtcagacaccctcagcgcctgctgcatgttatgcgtaacgataataatcgaataatcttttttcagttctgtcaaaagcgtctcgattctggcgtttgaaatagggtccagagcggatgccggttcatctaaaagaagcacggcaggtttcatcgcaagcgtacgggcgatgcaaaggcgctgctgctggccgcctgataacgacagagccgatgaatgaagccggtctttgacttcatcccaaagcgccgccttcgttaagctttcctcgaccgcatcatccaaaacggctttcctgcgttcccctgcatacttcagcgcatgtgtgatgttattgtaaatggatttcgggaacggattcggtttttgaaacaccataccgatctcccgtctgagagacacgacattaatcgcttcacccaaaatattcagcccttcataaaggatctctccctcgcttcttgccgaagcaatggcatcgttcattctgttaatctgtctcaaaaatgttgatttcccgcagcctgacggaccgatcagagccgtcaccgcatgtttttcaatattcatgtttacatcttttaccgcttgtttgtcaccgtaataaattgataaatgcttcacttccaaaatcgaagactccggcgaacgctttgtctgttccgcttgttccctgatgatgtgatcaatcatgttttcgcctctttccgattaatttgccgtaagctttttataaatgacagacccgagccatctcgcacaaaggttaaacaagagaaccgaaatcaccagcaccgccgagccgccgtttgcaatcgcttcggcgtcagggatgattccctgcgtattgacactccatatatgaaccgccagcgtctcagccggcctgaaaatgttgaaaggagatgattcagaaaacgggttcaaatccgtaaagttcagccgcggcgttgtcagccccgctgtaaataacaatgcggccgcttctccgaatactcttcctgatgcgagaatggctccggttaaaatcgaaggaatcgcactcggaatcagcaccgttttgacggtatgccatctcgatacgcctaaagcgagagaagcttctttcagctccttagggactgcagtgagcgcgccttctgtcacccggaccataacgggaaggttaaagaccgttaatgcgagcgcgcccccgataatcgtgtagccccatccggtcaagtttacaaacatcagcatgccgaacatcccgatgacaatggacggaagcgaagacagcacctcaatacacgttctgataaaatcggtgattttatttcggggcgcatattcagccataaagacgccgccccccacaccaagcggtatcgtgatcagcatggtgataaacagaatgtaaaaggagttaaaaagctgatcccgtattccgccgcctgaggcaatggcgctcgattttgacgtaagaaaatgcaaggagatttcagagacgccgtgaataagaatgtacaaaaacaatcctgccaaaatcgccgcgattacagcggcgcataacccgaatacaccggtggccaatttatccgttattttccggttcattacactttcctcctagatgacaagtagcgtatgagcaatataaacagaaacgacatgatgagaagaacaagccccatagaccataacgtattattttcaatactgccgtatgtggtatggcccatgtttaacgtgataatcgtcgttaatgttcccgccgtatcaagcaggctttccggcagaagctttgtatttccgataaccatctgtacggcgagtgcttctccgaacgctcttgccatcccgagcacgacagcggtcagcaatgtcggaaacgccgccgggataagcacctttctgattgtctgccacctcgtcgcaccaagcgcatatgaaccgtcgcgaaggtgtttcggaagtgacgcaagcgcatcagcggaaatcgatgtaacagtcggcagaatcattaccgagagtacgatcgttcccgccagaaggctgtgacccgttccgcttgatttaaaagagccgataaacggaaccaatactgtaagacctatgaatccataaacgacggacggaatgccgacaagcagctcaattaccggctgcagcactttttttccccaagtcggcgcaatttccgtcataaacacggcacccgcaataccgaggggcgctgcgatcagagcggacagaaccgtgaccgcaaatgatccgaaaataaaaggcagcgcgccgaactcaggttttgcctgggttggattccaattcagacttgttaagaactcaatcgggcttacaccatttacaaaaaaagattgcagcccctttatgccgagaaaaattgtgatcgccgctgatgccgcaatgataatcgcggcacacacagacacaatcacccttccgcggacttcatccaattgcctgttttgttttgagcttattaagcgttcgcttacagactctttttctctgtgatttatcatttgtttacactcctataaagaagaagaggcggggagcccgccctcccctcagctttgcttgccgtttgcgtcacgtgtgactttcatatcagagatcggaatgtagccctgatcttttacgatacttttctgtacttcatcgctgttcatatagtcaagaaacgtttttgtaaggcctgacgcttcacctttcgtataagagtgctcgtaagcccaaatcggatactcgcctgtgacgacatttttctcttccggtttgatgcctccgatcgataaaggcgttactttgtcatcgtttatataagagaatgccagataaccgattgctcccggcgtttccgcaatgatttttttgactgtattggaggaatcctctgtaatgccctctgcaggctctgctccgtcaagagcatatttgacgaacgtagcgcgtgttccagatgaatcaggacggttcacgagtgtaattttttgatctttaccgccaagttctttccagtttttaattttgcctgtaaagacatctgtcagctgttttttggttatatcctttacgcccgcaccggggttgaccgcagccgccatcgccactaccgctactcggtggtcttttagggctttcgcatcaatgccttctttttcttcagcgaagacatctgagttgccgatttgcactgccccttcagacacttgcgaaagtcctgttcctgaacctcccgcttgcacctgcacatcagcatccggatgtttttccataaacttttccgccgctgccagtactaacggctgcatggctgatgaaccagaaatggttaaagaacctgatgcttttttatcctcacttgcagattgactgtctgtcttgccgctttcctttgcatttccgcatgctgcagcaacaatcataacagcagccatcagaagcataagcatccatttgttttttttcatttcctgaattccccctgcatttaatgtgtaatttgtcctacacgtatagagtaaagggttcttgtaaaatgcgtataaatcaagtgttaaggttttgtaaatccggatgtttttttgtataaaaaaaacgctcacaggttgtgagcgtttttctgttagttgcttgtattgccgttttcagcgtcttcctgaattttatcttcgtttttctgcttcgtattattatcttcttgtttctttttcagctcaaagtatttgtccagagctgctcttcctatatcattcgtaatcgaatatcgatcgctgtaattaatataggcccaaggaacgactacagaaatagccacttccggattatcagcaggtgcatacgcgacaagagtcgtattatacgttccttcacccgtctctgatttgtcaggaccgtcatagaaagattgcgccgtacccgttttaccggcaggactgtatgtcgccgtcgcaaaatcagttgcggctgtcccttttgtcatgacacgtctgaaacctgcctgcacttctttaatgtctgcatgattcatatcaatcttattcagtacttgaggctgaacagactctacaacggctccgattccttttttcgaatcaggctgtctgacctcttttacaagctgaggtttcaaacgatagcctccattggcgatcgttgatacatactgcgccatttgcagcggtgtaaacgtatcatactgtccgatggcaaagtctaacagaagaccggaaattcgctgtgtcccttggtacccggttgcttcattcggaagatcaatccccgtcttaactccgagtccgaactgattgaagtagtatctgaaagtatcgaatgccttcatatcaagcggcagggactggccttttttgtactcccctttaccgacagcaatcgccgttttgaacatgaacacgtttgatgattcctgaagcgctttttggatatctacgggacctaaattcgtccatgattttttcgggtttttacttcccttgaaatacataggttcatcctggaaaacggtgttcaaattaatcgcgcccgtctgcagtccggtcaacaccgtcgctcctttgaccgccgatcccattgcgtaggaggaagtcattgcgccgagggcataatcattaattttgtactttccatggtcattcgtaatctgcttgccggccatcgtcagcacttctccgtttttcgggttcatcatgacgacgaaggcccgatcaagaagcttcgtgctcggtctcgcttttgccgatcttaaatttttctcaatgattttttcaacggatttctgcaggtccatatcaatggataaaacaaggtctttgccggcctgtccttttgaaatcactttgctgcccgtgacatttccggatgagtcggttaagttctgcactttctctttttgaccctgcagcaggctttcatattgatattctaaatagctttttccgaccctgtcattccggctgtagccgagtgacagatagtgatccagcagattggaaggaagaccttcgttcgcactggatacactgccgagcaatgtccggatcaggcttttataaggataagaccgttcccagtcagacgtcacgtcaactcccggcagttcatctaaatgttcactgacgacggccatttcttttgccgacaccccttcatttttgatgtattgaggcgtcagtgaatagcctgaatccatctgccttttgatcgcaaggatctgcatatcttttgaagtgagctcgttcagctgtttgtctgtgatacgtttcagctgaagctgatataaatcatcttcagacagttttttgtcttcagctttttgcttttcttcggccgtaatcagttttttcgcttcatcaggcctcgttaacatccaatagtcttttttatcccgctcagtcacctttttggtgcttaccttaatcatacccgacagtttttttgcgatttttaaacgctgcgcctgggtggttgaggctgaacgtgtatatgtaatcgcatttaatgctttattcgttacgataggatttaggttccggtcgtatatcttccctctcggaaccgccgtgctgacatcagactcctcctgcttattagcggcgtttttataatcatcaccctgaacaatctgcttgatgccaagctcgacgataatccaagtgaaaataagaaacgcggccaaaaacaaaaaattaagccggatcggcagtgattttttcttttctttgtttacagctattttctttttatttctcctcatgacatcaccttttcttatttacagaaagaaatgacaccttctgttcaggtgccatttttcattctaaaggttttttcgatatttttctacagataacccttttatctttctccttttataaaattcggttccgccgcctgtttttgtcggtcttcttctactgtttcatcagaagtttccgtatccagtttaatgtcttttataaagtaataaatcagcggatggccggctccgagcagcacgagcgccgccggtattcccactttttccttgaataatgtaacgattacaaggaaacaaaggatggaaacgatccggcccgcatttaaaaataactccctgagcacaatgtattcaattctggcttttctggcaagacgcgcccggcctatcacatcatatgtaagcgagacatacggcacgagcagaactggatagccgatcgcaataaacactccgtacaaaaggagcgtcgtgaagctcattttaaaaatgatgagaaacagggcgccatacaagatcaatccgccgataagaatcgcctttttccgagctctttttttgatgagccttgatgcaaaataataggcaaaaaaagaaaccgcggaattgacgagaccgaatgttccgagcgccagctcactgtttgtcgcaatgaatacaaatacgctgattaaaaaaacaaaaatcccttctctcaagccttgaaaaaagtgcgcgttggtaatccggcgccaattcagattcgtgtggcgctcatcaaaaacttttttcagcataaaccggcctttcgactccctccgcttcagaaaaaagctcataaccacggcaagggcaaataagccgagcgacaggctgaaaatgattgtataacccgtattgttttcaagtcttgaaatgacatatccggccacaatcggaccgatcatgcccgccgatgaagacaaaatgcctaaaaacccgttaaaaaaatctctcgtttccggttccgtaatttcgaacgtcagcacattaaaagccagccagtaaaagccgtatccaactccgagcacggcccctatcaaaacgagacgggaagcagcagtttctccggcaagcagcacacttaaataaaaagccgccaaaaagataacgccgaacctgagaataaacaccctgtcgatttttttagccagccggccagccagcagaaaggtaaccggctgcatcgttacgaccgacaaattgtatatggccaaatcaataaattttcccgactgcttccacaaatacacgttgacaaatgtatttgacagcgcgatgcccaatgagtaaaggccgccaatcgtcaataacagcagcagccctttatttatttcgatgtcgccgataattttttttattttgctcatcattgactcccctttactacacattagtttgtctcactcaaactgagatatgtaaaaggattcaaagtcaataaaaaaacaaggcctcccgcgggagaccttgtttgatcgaactatttattttgcttcgctgtaaagacgggcaacttcatcccagttcacaacattccagaaagctgaaatgtaatcaggacggcggttttggtagttcaggtagtacgcatgctcccaaacatcaagaccgaggacaggtgttttaccctctgaaagcggtgaatcttggtttggcgtgcttgtaatttcaagtttgccgttgtttacaacaagccaagcccagcctgaaccgaaacggccggcagctgcggcggcgaatttttctttaaattgatcgaagcttccgaacgtgcttttgatctcttcagcaagctcaccagtcggttcgcctccgccgttcggagataaaagagtccagaataaagagtggttggcatgtccgccgccattgttgcggacagctgtgcggatgtcctccggcactgcgttcaaatcagcaacaagctcatctacagatttctctgcaagcgctgatccttcgatcgctttgttgaggtttgtcacgtatgtgttatggtgcttcgtatgatgaatcgtcatcgtttccttatcgatatgaggttctaaagcatcataagcgtaaggcaattctggaagtttgtaagccataatttttttcctcctttaaatatatgtactgaaatgccgcttaacgcgaacttttctaatctcaatgtaacaaaagaaagcatggtaatcaatgaaaaagctcacaatccggcgattccagcagacatattacactttatccgttcactgccgaaattaaacctttctaaagcaccgtccataagaaatatccgatcataaagagctgaatgacgccttttgccgccacgcttgttaaaaagccgattaacgagccgagccccacttttgccgcggacttgatatccttttgatgaacaaacacctcagcgcagacagcaccgataaacgggcctattataatgcctgccacgggaataacgaagggcccgatcaacaatccgatcgtgcttccccagattgccgccctgcttcctccgtaccttttaacgccaagtaaatttgacacataatcagctgcaaataaaacggccgcaaataccgcctcaatgagccaaaacaggtaagaataaggactgaaggaaaacaaaaatccgtagagaagaaaaccggccacaataaaaataacgcttggaatcaccggatatacaagcccgataaaagcaatgacgaagaccgcaatgataatcagccaatacaaaacactcatgacaaaaacaccctcctttgttttgcgggcgatcaccgcttcccgctttatcttattatgtatgattccttatcaccgctttaaatactctcacttgtgttcatcccctgtgaacgatacaataagcaacatataccagtttaggctaggaagtgaagatgttgaacatatttacggctttattgaaaagtacatactctccggcagatattgcaaaaacacggtttcaggggataggaaaagcgatcctttatgtatttttgctgtctgtcctttttacgctgccaagcgcttattacctttgctccggcaccgtaaactcaatgaacggtttcaaaaccgtgttaaagaaagatttccctgatttcagcatttcaaacggagaattgcagacgaaagcatccgcctctaaggaaacggaagcgaacgggttcgtcatcgtgtttgatcccacagatgcttacggcgctaaacaaatagcggcgaaacaaaatgcgatcggcattttgaaaaataaaatggtgcttgctgtagacggacaggcgacagaaatgaattattcgctgatgcctgccgatatcacaaaaaaagaaatcatatcagcattaaaccaaaataaaacaatgatcgtcaccgtcctgtccgttttgctgttcatcatgacagcggccggcaaattcattgaagtatcatttctcgccgtcatcggcctgatattgaaaaatgcgcaaagaaagacattgaattaccagcagctctggaagctttcggcttattccattacactttcgaccatattctttacgatcatgcgcgcgcttgttattacggtgccgagtgaatttttagtgaattggtttgtaaactttatcatccttttcctcgtcttaaaagagataccgcgaagtaaaacagctgtgtaacaaagactgcccccggcggtcttcttttttgtcatgaacaaaacgggacaagcatacaatgaagtaaaaatgtatgcgggaggcggttggaatgaagcggcttacttttgtattcggcagtttatttgtgatattcattatcttttacgatcttaaaatcggcacgatcccttctcaagaccttccagcatacgcagcggcggcacagccagcccaacaggaagcttcatacagaacggttacggtcaaaaaaggcgatacggtgatgtcgatagtcggcgcacataaagcgccagatgatattgcacaagattttgaggcgctgaatccgaatgtaaaagcaaacgccattcaggcaggcaccgcttataaattccccgtctaccgcaattaaacgttaatttcttgtcagttcggcaaatacactgttacaatataacatgtaaatagaagttgcctgacatgtaaaaggctcagcctgcaaaagcggtaactacaattaaggagcgattgacaagtgagtgaaatcacacatcgtacaaaaacgcgtcccgtcaaagtgggacctttaacaataggcggaaataacgaagtcgtcattcagagtatgacgacgaccaaaacacacgacgtagaagcaacagttgcggaaatcaaccgtttagccgaagccggctgccaaattgtccgggtggcatgtccggacgaacgcgctgctaacgcgattgccgacatcaaaaaacaaatttccatccctctcgttgtcgatattcattttgactacaagcttgcattaaaagcaattgagggcggggccgacaaaatcagaatcaacccgggtaacatcggccggcgcgaaaaagtggaagccgtcgtaaaagcggcgaaagaaaaaggaattccgatccggatcggcgtaaacgcgggatctttggaaaagcgtattttagaaaaatacggctatccgactgctgacggaatggttgagagtgcgcttcatcatatcaaaatcctggaagaccttgactttcatgacatcatcgtcagcatgaaagcctctgacatcaatctcgccatagaagcatacgaaaaagcgtcaaaagcatttgattatccgcttcacctcggaattacagaatcgggcacgctgtttgccggaacggtaaaaagcgcggccggactcggagcgattttaagcaaaggaatcggaaacacgctccggatctctctgagcgccgacccggttgaagaagtgaaagtagccagagaactgctgaaatcattcggtctcgcttcaaacgcggctacgcttatttcatgcccgacatgcggacggatcgaaattgatctcatcagcatcgcaaatgaagtggaagaatacatttctaaagtcaaagcgccgattaaagtagccgttctcggatgtgccgttaacggaccgggagaagcaagagaagccgatatcgggattgccggcgcgcgcggcgaaggacttcttttccgcaaaggccaaatcgtccgcaaagtccctgaagaaacaatggtcgaagagctcaaaaaagaaatcgacaagctggcagaagaacactatgcaaagcttgaagcggaaaaagcaaaagcagaacaagaaacacaaaaagcttgacggatattccgccaagcttttttttgcgttgtgttaaaaaaacggtgtaatgaagatgccaagcacaagggaaacaataccgattcccatcgcccatccgcctaaagcgcctgctcctcttcttctggcgatatagccgacgataatgccgcatgcccctaataaaacagggagcacaaacagggaaatgatagaaatagccaatgctgcataccctatcccccggccttcacttactccgtcccgattatcatcacggtctgctgcccggtcagaagcacgatatggctctgagatttcggccgctgtttcttctgaataaacatcacgcgtgatatcggttccttccgatccatgatctacatagtaatcgttgccttttcgattttcgtaatcgtatgccaccttcaattccccctttttcttttatgaaaggagcttttttagtttccgcgttttttacgaattcatgtttgctaaacttttctggtattgttaattgtttatgttacacttgaagggatgaatttataggagtgtggacatgttacggttaggtatagatattgacggcacagttacggcacaggatacatttgtcccttatttaaaccgctcatttcatctttccattaccttggatgatatgactgattatgatctgacgaagcttttgaacattacagacgaggaattttgggaatggatgaacgttcatgaagcagccatatataaagaagcgaagctcgcggaatttgccaagcaggcactggacggactgaaagaagagcaccgtcttatctacattacggcaagacgcggccacttagcagatgttacgctggactggtttgcaaatcgggacattcattacgatcacattgagcttgtcggaggccatcacaaagtggaagccgtcaaaaaacacggcattgatttatttttcgaagatcaccacggcaacgcgacaatgatcgcaaaagaagcaggcattccggttatcctttttaactccccatataatcagctccccatcgattccaatattatcagggtgcagaattggcttgaagccgtcgcctggattcataaaaacaaacacagctttcagcatgttaaaagctgaaaaaaacctcctgtataagcaggaggttttttatcggcacgcaggacaggtgccgtaaatttcaaacttatggccgctgatttcatacccttccaaatcatcgtgcagcttatccatcggacaggactcaatttccttcgttttcccgcaggttaaacagataaaatggtgatgatgatgggtataagagcatgtaaaacggaacagtttttctccggaaagctccgtcgtttccaaaatgccgagttcttcatataacgaaagatttctgtatatggtatcaaagctcagacccggatagtcgtcatttaatgcggcaagcacgtttttggcggtcagatatttatcagaatcagcaaaaagctgcagcatgtcttctcgcttactcgtatatttataccctttttctttcagcaggttcaacgcttcttgtacgttcatgaggacctcccctttacaacacggtatcgctccaaaaagaaaatggcagctgtctgaacagcaggccattttcttatgatgtatcaaattatacctataaaatgatgaaaagtaaatgaaagcctagtgaatcgcggttttgaacttaccgcccctcgtttcatgggtattcatgatcgtaataaaggcgtttttatcaatttcaaacacaatggatttcaatttagtcacttcaagccttgtcacgaccgcgtaaatgacttctttggattcatccgtatatccgccttttccctgaagcttggtggttccccttccaagccgatgcaagattgcatctgaaatttccgcatactgatctgccacaataatgaccgcttttgtttcatcaagcccctggatgacggcgtcaatcgttttcatggcaatataataagtcatgaaagaatacatcgcctgctccggaccgaacacaaaaccggcccaaataaaaataaacacattgatgagcataacgaattctccgactgagaagggcagcttttttgtgagaaggataccgagtatttcagtaccgtccatcgagcctccgtttcggatgacaaggcctaccccgaaaccgagcaaaagcccgccgaataccgtcgccaaaataggctgggtcgtaatggcctccacatggtgcaaggaggattcaatcagcgctaaaccgacgattccgataacagtagagatgagaaatgtttttccgatatatttatatccgaaaatcataaatggaatgttgagtaacacaacgaataaggcgaaattgaggaggggattggacataaagaggtggtctaaaattaatgaaacaccgataatgcctccgtcgataaaattattagggaccagaaacaattcaatacttacagcggctgaacccgccccgatcagaatcatgatgaccctgaagataaagtgtaaaaatgattctcttttatgctgtttatttggggtcataaaatctcctttcctgtaataactattttaaacagtaagcaacttcattttaccattaaaagccgtaacattttaatgatttgctcaatacattatgtctaaagaggtgaaagtatcgatgattttaatacaaagaattattttgcagcggctcaatcaagtcactgcggacgatcttctgaaatattccaagcaatacggaatcagcattacgagaagtcaagcggctgaggtagcggctctgatgcacggaaaaaacgtcaatatttttgatgaacaggagcggcttcgcctgctgaaaaaagtggaaacgataacctcaaaagaaacggctcggaaagttgacgaacttttcaatcaattctcagggtaaaaaaggaggggcaattccccctccttttttattgagctgatatttttttaagaagctcctgatcaaactgcttttctttcagcatttcgatttcaaaacggtacggcggcttcttatttttcttgtcttcgcctacatacggtgtttcgaggattttcggaatatcggcaagctgctcgtgatgaacgatgtactgcagagcgtcaaaaccgatctctccgaacccgatattttcatggcggtctttccgggcgcctttaatattcttactgtcattcacatgaaggacttttatccgatcgataccgacgattttatcaaactcgttaagaacgccgtcaaaatcattggcgacatcatatcctgcatcatgggtgtgacaagtgtcaaagcagacggatagatgttcattatgcgtaacccccgaaatgatctcggccagctcttcaaagcttcttccgcattctgatcctttgcccgccattgtctccagcgcaatctgcacgtgttgaccgggaacaatcacttcgtttaaaccttcaatgatttttttgatgcccgtctcagccccggctccgacatgcgcccctggatgaagcacgatctgtttcgcgccgatcgctgccgttctttcaatttcagaacgcagaaaatcaacgcccagctcaaacgttgccggatttgtcgtatttccgatgttaatgatgtacggcgcatgcacgacaatctcgtcgatgccgttttccttcatatgggcgcggcccgcttcaatattcaagtcttcaatttttttgcggcgcgtattttggggagcgcccgtatagatcataaatgtgttcgccccgtatgaaacggcttccttgcttgcggcaaggagcatatgttttccgctcattgagacgtgtgagcctaatttcagcaacccgattccccctactttcctctgttagattggtttcttctctgcttctttctgattttttccatttcgtagctcattttctttttatagcccggctttacttttttcggctttttcacaaggcgtttcgccatttggtcagcctcatttgccgtctttttgcgatttttgcggcggtggcggtcatcgcctttcttccattcgccgtttacaagctccgcatattcaaacacaatacccatcttttcgagtcttacgagcgcatcttcgtcagaaagctcataaatggtcagtgcttggcctgatgaaccggcgcgtgcggttctcccgacgcggtgaacataaaaatccagatcgtccggaagctcatagttgatgacgtggcttacgcctttaatgtcaattcctcttgccgcaaggtctgtcgcaatgacataagtgaattccagatcattaatctgcttcattaccttcttacgctcacgcggcgttaatcccccgtgcagaagaccgatcctcatgcccttttcagtcaggtatttcgcaatatggtcagccgtgtttttcgtattggcaaacacaatgcccagataagggttcagatgagacatcatatcaaaaagcagtttgtctttatcacgctgtttagaaggaaccaaaacatgttcaatcttttcggctgtgattcttttcggctcaacatgcgcgtacttcggattttccatatactttttcaaaaacggcttcagcttttccggaatcgtagctgagaacacaagcatctgaagttcttccggcatccgcgatccgatataatcaacgtcttctaaaaagcccatgtcaagcatcagatcagcttcgtcaatgacgagagactgcgctttatagacgttcaatgcctgcgccttaatcagatccgcgatccggcccggcgttccgacgacgagatgaggctgtgttttcagcttatcaattgatttttgcttgtccgtcccgccgatgaagcattttgtccggatcggctcatcttccgcaccctgtgtgattttgagcgcttcctgatgaatctgattggcaagctctctcgtcggcgccgtgataacagcctgcaccgtatcagaacccggatcaatccgattcaaaattggcaataaataggcgtgggttttccccgtccccgtctgggactgcccgatcacgctttcgtttttcagtacggcaggtatcagccgcttttgaatatctgtcggttcataaaaaccaaggcggtgaactgcatctataataaacggttttaagttatatccatcaaatttagtttctttcatttttcccagctccttaaagcggcacattctgtgtccatcatcacattataaccgattttatttaaaaacaccatgtcttgggggaatcctgttttcgagacagaaaagcaaatgccccctccgatgcatattgtaatagcagagagacagaaaggaggtacaagtatgtttccacagcagccgatgagaaatatggcgcagcagggccggccgttgatgaatccgcgtatgaggatgggaggaagaccgtcattgccgggccggcagctgatgcagcagggccggcagcttttccctcagcagcagattgccggagcgggcctgagaaacgcaggcacgggcggcggagggggcttaaaagggatgctttcccgttttttacccggttcaggaggaggaagcgctgccgcgtctgcaccggcggcggccagcggaggagcaggtgcaggactgcagggaatacagaacctggcaagtccggcatccctgtcgagcatgctcggcaacgttcagaaggtgctcggcgtggcgcagcaggttacgccgatgatccagcagtacggtcctttagtacggagtctgcccgccatgatgaagctttacagccaattaagcagcagcgatgatgagaatgaatctgacgagacaaaagaaacagacgaacaggacaaaaaggatgaagctgaaaaaacagatgaaacagaagctgaaaacaaatcagacgcctcatccaaaacaccaaagaaaacgtcaaaaaaagcatccgcttcaaaagaaaaagacgccgcacaggcagaatcagcggaacagccgcgtccaaaaagaacatcgggcagatcaaagccgaaattatatatttaacattctttgatatctcacgaaagattagctataatgagatcagaagaatgcaagatttgagccgtttaactacggctttttatattgcctctacactcacttttgataggaggacatctacattggacgttatcaaaatatcgccgcgcggctactgttacggcgttgttgatgccatggtcatagccaaaaacgcgtcactcgataaaacactgccaagacctatatatatactcggaatgattgttcataataagcatgtcacagatgcgtttgaggaagacggcatttacacgcttgacggtacaaaccgtctggagattttaaagcaggtggaaaaaggaaccgttattttcacggctcacggggtatctccggaagtaagaaaagctgctgaggaaaaagggcttgttacgattgacgccacatgcccggacgtcacgaaaacacatgacttaatccgaaaagtaaaagctgaaggctatcatgtcatatacatcggcaaaaaaggccaccccgagcctgaaggagccgtcggcgtcgctcctgaaatcgttcatctcgttgaaacagaagaagacgtgagaaatctcgatattcaggctgagaaattaatcgttacaaaccaaacgacaatgtcccagtgggacgtccacgatattatggaatcagtcaaagaaaagtacccgcacgtggaataccatcaggaaatctgcctggccacacaggttcgtcaagaggctgtatcggagcaggcaaaaaaagcggacttaaccattgttgtcggcgatccgaaaagcaataactccaacaggctggctcaagtgtcagaagaaatcgccggaacaaaagcctaccgaatcggagacatcagtgaactgaagcttgaatggctgaaagacgtcaataccgtcgccgttaccgcgggcgcatcaacaccgacaccgattacaaaggaagtcatccgctttttagagcagtttgaccacaacgatgaatcgacatggcagcttgaacacagtgtgccgctcaaaaaaatccttccgaaagtaaaaataaaaaactgaggcccggggcctcagtttttttataagaaggtaaatgggtttgtatctgtttcggaagcgaaaatgcgcacgtcatagtttttctctacggccattgccgtaagcttctcagccgtgccttttctcatgatcttttcagcataatgccccgggtctacgacgtttaatcccatcatcatcgcatcctgcgctacgtgaaaataaaggtcgcccgtcacgtaaacatctgcacctttccgctttgcctgataaatatatttatttccgtcgccgccaagaaccgcgacttttttcaccttgctgtttcgctctccgaccatccggactccgttaacgtcaaacttttctttcacaaacagagcaaactcttcaagcgtcatgtcctgctgaagttttccgatccggccgagtcctttttcaagcggagactgctccaccggataaatatcatacgctacctcttcatacggatggctttttttcagcgcttttacgacggttttctccatacttgccggaaaaacggtctcaagtctcacttcatggacgagttccagctctcccgtctgtccgataaacgggtctgccccctccagcggcttaaagctcccgattccctcagaagagaacgcgcaatggctgtaattgccgatatgtcccgctccggcgttgccgagtgcggttcttacagcttcttcatagtctttcggaacatatacggcaagttttttcatcgggtccgaatatgtcgggacgagcacttctgtgtctgtcaggccgagagcttcggcaagcagatcgttaacaccgccgtccgctacatcaagattcgtatgagccgcatatacggcaatatcatgctttatacatttctcaatcagtcttccgcccggctgatcagtggtgatctgtttaagcggccgaaaaatcggcggatggtgggcgataattaagtcaacttttttctcaatggcttcatctaccgtttgttccagaacatccagtgtcaccatgacatttttcaccggcttattcaatgtaccgatctgcagtccgattttatctccttccaccgcataagccttcggtgaaaattgttcaaacagctggatgatttcctgtccgttcacatgtttaggcatgtccgattacctccttcagcagagaaatccgctctttcaattcagctaatttttcatgattttcatgctttgcgctgcggctgatctgttcataaatttgttcagtatgcttaagttcctggctccatttccgaagaaacacttcgttcctctcttttaataaaaacggacccgcaagcattccggcagccatcggcacgtcccggtacggcgcatcacggtcgccagtttccgcaacgaggatttcataacactttccgtcttcttcgagaatcacttcatcaagcagttcataaccttcctgatacagccactctcttatatgaacggcatgaatattcggctgcagaatcagccgttcacgccccgtcaatttcgtttttcccgactccaaaatatgagcgatcagcgctccgcccatgccagcgatcgtaatggcgccggcttctcctttttcaaggacgctcagcccgtcacctttccttacggagataagagtgcttaagtccagtttttccacctgctgtttggcggatagaaacggtccgtctgtaatttcaccggcgattgcgcggcttgccaaatgattcaaaacggcatagcaaggaagatacgcgtggtctgacccgatatcagcaaccagggcacccggagggatatattccgccacagactgcaatcttttagataacttcatttcattcacaatatcacaacttttctcatgttctttttcctttactatcatataaaaaaaccgcccggaatccaagcggcggatagagtttttcatatgtcttttatatagggaccggtaaagctttatttaatgtcagaaacccattttgccatgtcatccagcttttcggccggcacaaggcccgcaggcatcccgttgccgcctttttcaatttttgttttaatctcagcgacatcttttcttttgccgacgccttttaagttcggtcctgacacaccttcatagttttccccgtgacaggtgatgcagttcgctttataaatctcttcaggtgaagcgtttgcagtttccttctcggcatttttgctttcaccgccgcttgcgatctgatgcgcatctccattgccttttacagctaaaaagaaagtcagccctattcccagcactgcaatgagcaaaaaaggaatcagcggattccacttcatatctccatccccctttttcattctccccctatgtaaacacttctaattctaacttatttttacaaaaagtaaatggtcttgctcagcaatttcattgatttcacaatttatacaaaaagcaaaaataactgttttgtttatcacaaaattatctttattctattgtataatgaattgtatacgcttacaataaagaatataaataaacttatctcattttccctctttcaggacatgccgcattttttccgaacccatttgcaaaacatatgcttatccagtaaaataaaggtatattatccatatatcttatacataaaaaagaacggatcaaaaagacccgttccattctattcgagaaaatccttcagacgtttgcttctgctcggatgtctcaatttacgaagcgcttttgcttcaatttggcgaatacgctctctcgttactccaaacactttgccgacttcttctaaagttcttgtgcgtccgtcatccagaccgaaacggagacgcagcacgttttcttcacgatctgtcaacgtatccagcacatcttccagctgttcttttaaaagctcatatgccgcatgatccgacggagatgtcgcttcctggtcttcgataaaatcaccgagatgtgagtcgtcttcttcaccgatcggcgtttctaaagaaaccggctcttgagcaatttttaatatttcacggactttttcaggcgtaagatccatgtcttcagcaatctcttccggtgtcggctctctgccaagatcctgaagaagctgacgctgcacccggattaatttgttaatggtttccaccatgtgaaccgggatacggattgttctcgcctggtcagcgatggcgcgtgtaatcgcctgtctgatccaccaagtcgcatacgtactgaatttatatcctttacggtagtcaaacttctcgacggctttcatgagacccatgtttccttcttggatcaagtctaagaaaagcatgccgcggccgacataccgtttagcaatgctgacaactaaacgaaggtttgcttcagccagtctgcgtttagattcctcgtcaccctcttcaattttttgagcgtaggtgatttcttctttagcagaaagaagatttacccgtccgatttccttaaggtacatgcggactggatcattgatctttacgccaggcggtacgctgaggtcattaaggtcaaattcttcttcggctttggcaagctgttgaatattaggatcttccgtttcttcattttcactaattaattcaacaccttgttctcctaaaaattcataatactcatccatttggtctgattcaatttcaaagctggacatgcgttcagcaatttcttcatatgttaaaacgccacgtttttttccagtttcagtaagctgttcttttacctggtctaatgtaagttctgtttctgtttcgtgggtttgtttatcagccattatggatccctccttccaaagcttgcaacgaattctaaaagcggtatgtttcttatccgccccggaagccttctctctttttcagcatgcagggctgcggataataatgacaattcatgatgaggttaagcgatctatttgctcctccgcaaggaatcattgccaatcagaacgcaagcctctttttggtgttactttaatgatcggttcaatgcaacaatttcttgagccagagacgcagctttcacgaagtctttctgcctctccgcatccgctctttctgcttctttttcctttatcattgaccattttcggtgatccaacactttttttacgtaatcggataactcggcctctgagagctcctcgtttacttggagcatccctatatctgaaagcagctggctgatttcctcatcctgcattctcgccataagatgctgcggcgtcatgtcagcaccctcttcataaacagcgtacaggtatgctgccagcgcacgatgtccgtcaatgttaaattcaaagccgacacgctcaatcactttctttatgacgtttcggtctctcagcatatgagcgagcagaagtctttccgcgttctcataggcgggacggagacggcgccgtttcgcttttgtcgtcacccgggcccgtcttgtctgcggttcggcgtttttgtcgccgggggcgttttgtctggcgtagatggaaagctgttccgtcaaagattctaccgaaagagaaaattcagaggcgagctgcttcacatacatttcctgctcaagcgacccggaaagagcgctgatttctttcagcacttctttcatgtaagcgagccggtctccttcgtcagataagtttttccctttgcggaaatattgcattttaaaagccatgaccgtaacgcttgcatcaatgatatcggtccggaatttttctccgccccgggttctgatataatcatcaggatcaagcccgtcaggcagcatgcttactcttaccttacaatcagctttctggagcaggccggccgctttcagcgtagcttcgtacccggctttatccgaatcgtagcagagaatgacctcctgaacatttcttctgaggattttcacatgctcttcggtgagcgacgtccccattgtggcgatactttcttttacgcctgagctgacggcggatatgacgtcagcgaagccttcaaacagaacggctctctcctctttcctgatcggcaggcgcgccttatgaaagttatacagcagcttagatttatgaaacagcggcgtttccgggctgttcatatacttcggctgctggcttccgagcgcccttcctgaaaaagccgccacggctccgtggtgatcatgaatgggaaacataattctgtttctgaaacggtcaaaatacccgctgccgtcttcccttctgatcagcagacccgctttttccatcatttcttcctcaaaaccgcgctttttcaagaatttcgtcatgaaatcccaggaatccagcgcgtagccgatttcaaactcatctatgagctctttcgtaaaaccccttgataaaaggtaatctaacgcttcctggccttcctttgtatttattagcaaatgatggtaaaatttcttcagaagctcgtgggcttccgccatcttctgctctccggaagattcaggcctggatgcagagtgaatcgttatatcatcagggaaatcaatctgatatttatccgcaaggtgagaaacagcttccgtaaatgaatagccttccatctgccgtaagaaagagaaaacgttcccgcccgctccgcatccgaagcaatgaaagatctgcttatcgctggagacggaaaacgagggcgtgttttccccgtgaaacggacagagcccaaagtagttgcggccttgctttttcaattggacataatcacctatgacttcaacaatgtctgctgactgctgcacctgattaactacttcatctggtatgcggtttcccatcttataacactccgtcgtacattattcgatgttttgatttgaaatcccttcatcattcgacaggatttttttaagcagggtaacaaatcgattccgatcttctttatttaattttttaggtcctttggaatgaatgccgcttcttctcattttgcctgacatatgacggctcatcagagcgaagtcaatcgtgtcttcagtataagaacggcccctttccgataagacggcaatatttctgttcagcaaaagagatgctaaaccgatatcctgcgtgactacgacgtctcccgatctcacatggtttgcgatatataaatctgccgcttctttatgaggatcaacgtatacccagttctcgtctttgcttctggaaagctggtagtgttcaaatgatgcgacgaaaataacccgaacgctgaattgcgatgcaatgagcattatttcctcttttacggggcatgcgtctgcatcgacaaaaatcgtcttttctttttcatttagaagactaattctccatccctccatcaatctcctgcataaaaacaagcgaaatcgcatatgctccatgactgcggatctattttgagctttgtcgaaaaatttccgggagttattcttgacatcttacccataatagtttattcgtatcacacgaagcttaaacctaaaaataaacattttatcacaattttttattataatacaaacttcgcgaagatgccatcctttttgtttattccctatttgcatacccaaaaacccaggataaagcgtcctgagttatcggccctttgttttgagatgatgaatgatgttcgctgtttcttcgactgctttattcgaaacgtcaacgacttggcagccgatccggtccacgattttctcaaaatactccagctcttctttaattctgttgatattggcgtaaatggctttgtcatttaagccgagagattttaaccgttctttacgtatatggttcagtttatcagggctgatttttaagccgatgcattttttcggatcaacgctgaacagttcttccggcggatcgacctcaggaacgatcggcacattggccactttcagacgcttatgggcaagatattgtgataatggggttttagacgttctggatactccgagcaggatgatatcggcttttaaaatgcctcttggatccctgccatcgtcatatttgacggcaaactcgatcgcctcgacctttttgaaataatcttcatcaagctggcggacgcggcccggttcatatttggcggtcagaccgtaagccgattccattttatcgatgagcggaccgataatatcgtaatacagcacattcgctttttccgcttgttcaaccaggtatttgcgcatttcaggaacaacgagcgtaaaacaaataatgccgccgtccgctttggcgagagacacgacttcattaatggtgccgatatcttccacataaggtattcttctgatatgcgtatcatcggctgagccgttaaactggctgagcgaggcttttacaacgagttcggcggtttctccgactgagtctgatactacataaatgatgcgattgtccatgttatccccccgttagttttcaagcttatatgatttcattttctgataaactgacaagtatcttagtcatattcgttttggtaaaccggccgatgacctcaaagcctttatccgtatctttaataacgggcagggcatcgatctgtttttcaattaaatacttggcgatgtccatcacataatcatcacgccggcagacggcgatattcggcattcttgtcatgataatatgaaccggtattgaggcaagttcctgctggccgatgctcgcccgcagcaaatctttgcgtgacagcacaccgactaagacagcatcacgatctacgacaaataacgtgccgacatcttctaaaaacatggtgcagatggcatcgtataccgagacattttcattgatgacaacagggatcgattgaaaatctttcacttgcagctttttcaatttatccgcaagcagctgatttcccgttttccccgtataaaaataaccgacccgcggacgggcctctaagaagcctgacatggtgagtatggccaagtccggccgcagcgtggccctcgttaaattgagctgttctgcgatatgctctccggtaatcgggccgttttcctttacaatctgtaaaatttgttcttgccgtttatttaattcgatcgtactcaccacctttatggaagggtttctttatctatgttttcattctgtgatgtttatgtaaaaggggaaaagacgattgccgatcacacagcaaccgtctttttctttattttacaataagatgattcatattagcaaaagacttgattacatctgcaagagcggccatttgcgctaaacggttggtttttaatgcttcatcgtccgcatttaccatcgtgtgattaaagtaatcttcgatcggctcttttaatccgctgagcacggcaagcgcctgttcatagtttttggaggcaaagctttccgcgacactgtcttttgttttttcataagcgtcaaacagctttttctcctgttcattttcaaacagatccggcttgatatcgcggctctcgccttttttactgatggagataacccggccgagtgattcagccgtttctttaaagccgggtgtgccgaggtgcttctcaagcactcttgccttatgaacggctgcatacggctcaagttctgtgctgtccagaacggcttcaataacgtcatgacggatgtcttcggcgtttaagacgtatttcagacgctgtgtaaagaaatcgaggagttcattttctttttccgtttctgtcaacgacagcagttctttaaaagaaatgccccagttgcggtcgatcagaatggaaacaatgccgcttgcctgacggcgcaatccgtacggatcctgagaacctgtcggaattacgtcaatgctgaagaaggaagcaatcgtgtccagtttatcagctaacgccacgaccgcgccggtaaaggttgaaggcacttccccccggccgctctcggcatatagtgctcattgacagcggcagcgacggcttcatcttcaccgagcatgcgcgcatatttttctcccatcacgccttgaagctcagggaactcatagatcatatgtgtaaccaggtcaaatttagaaatctctgcggcgcgcttcacaagtttttgcgtctgttcatccgctttcaggcggacggcaagtttgcccgcaatggtgaccgctcttcttactttatccccgagggagccgagctcttcatggaaaacgatattttccagtttcttcacgttttcatcaatgttcagcttttggtcttctttgtagaagaacgcagcatctgaaagccttgctctcagcactttctcgtttccgcgggcaacattttcaattgcatggctgttcccgtttcgcaccgtaataaaatgaggaagcagattcccgttttcatcttttaccgggaagtagcgctgatgctctttcattgttgtcacgagcacttcttcagggatagaaagaaactcggattcaaaagatccgtaaagcgccgtcggatattccaccagatggttgacttcgttcagcagatcctcatcgaccggaatattccattttttcttggccgcaagcgcatccagctggctttggatcatttgtttgcgttctttcgggtcagcaatgacgctttgttctttcagcagcttttcgtatgatgacggcacatcaacagatacttcttggccgagaaagcggtgtccctgcgtgttccggcccgtctcgacatttgtgatttcaaacggaatgacatcttttccaaagagggcggcaatccatttgatcggacggatataacgcagatcctgcgtgccccagcgcatgtttttcggaaaatgcattccggcaatcaaattttccagctgcggtaaaagtgtcttcgtctcttgtcccgcctggaatttttgaacgaagacatattccgtgccgtttacatcttttatatacaggtcatccactccggcgccttggccttttgaaaatccgatagcggcttttgtccagtttccgtcagcatccagagcgatttttttcgcagggccttttgcttcttcctgaatatcagcctgtttttctgctacgtcttttatatatactgccagacgtctcggcgtattaaaaagtttcacttcgccgtgggcgatatttttttcagcaagccagccggtcagcttttcaccgagctgcaccatgctgtcatgtaaaaaccgcgccggcatttcctcgagtccgatctctaaaagcaagtcttgtttactcatgggaagagccctcctctttaagcattgggaaccctaatttttcccgttcttcataatacgtttttgccacttttctcgctaagttgcggacacggccgatatatcccgtccgctctgtcaccgagatcgcgccttttgcatcaagcagattaaatgtgtgagagcatttcagcacataatcataggccggatgcacaagcccgttatccatttgtctgatcgcttctttttcataggtgctgaacaaatggaaaagcatatccacgtcagatgtttcaaaagtataaacggaatgctcgtattcagccatcataaataaatctttcacagtaaatcctgacgtccattcaagatcaaagacgttttctttatcctgaatatatgacgcgagacgttcaataccatatgtgatctcaacggacaccggtttacattcaattccgcctacctgctggaaatatgtaaactgagtaatttccatcccgtcaagccatacttcccagccgagacctgcacagcctaaagacgggttttcccagttgtcttctacgaaacggatatcatgttcaagcgggtcaatgccgagcgcacgcaatgaatcaaggtaaagctcttgaatgttatcaggcgacggcttgataatgacttggaattggtgatgctgatagagcctgttcgggttttcaccgtaccgtccgtccgcaggccgtctggacggctcaacgtaagccactctccacggctccggcccgatgcttcgtaaaaatgtatacggactcattgtgcctgcgcctttctccacatcatacgactgcatgagcacacagccttcattcgaccagtgcttctgcaaggttaaaatcatatcttgaatgttcatttcaagcacctccactttctccattcttttacaagtgcggcggcaaccaaaaaactcccgtctctatgcttgccggccgcaaacatagggacgagagttctcccgcggttccaccctagttgctgaggatgtgaatcactcagcctctttttaaagggttgctcgagaatgcctttcgttgcgcgctcatccttagcttacactgtcctaaggtcgcttgtatgagttggacgcaagtacttctttctgtcactgcaacatattttataataaatgatcatataaaaagatgggcagaatgtcaacttttgttttcatccaaaaggttcttcatgctttccatctggtctaaaaaccgttttgactttaaataaagtcctgaatattcctcgtaatacagatcaatgacctgtttaatttcgtttttggtttcctgttttaacgagacgctgccgagccttccgatatcaaagtaataaaaaagccttagcagccttgccgtttgcggcgaaatcggaactctgtacggatccttttcaaagcagcggtggcagataaaaccgttatctcttatcgaaaaatgaaacgtcccttccccgcttttgcagtggacacaatgattcagctccggatacagccccatgacgccgagcattttcatctgcacgatgaatgtgatcacgtccgggtcagtcccgtcattcagcctcttaaaggattcgagaatcaattcgaataaataggggttcggtttcttctcttccgttcctttgtcagtgagttcagcgataaaagcggcatacgccgtcaaaaataaatcttctctgatcgttctcatgctgagaatcatttcaccctgctggagcgtgccgagtccggatgttctttgcattaaaaatgacccgtacaaaaacggctggctgactgctgacagccggctggctgacttcctggcgcctcttgccatgacgccgattttgccgtgttccctcgtcagcaatgtcacgattttattcgtctccccgtagtcattcgtacggagcacgattccttcacatttagtcagcatttccgcaccttccaacaacgggaggggccaagaggtttacaaaattggaaaatcaattcgggctagctcatcttccggttcttcgggtctttccaggttctctttttccagttctttaaaaagaaggtacgtatcaacacttcctgtttgagaaaatacgttccaggtaaaattcaacacaaaaaacccacctttcatcattaaactagcttgccaatccaaattcttacccttatcttgacctgatgtcctccttttcatgttaaacaaattttgctaacgaatccctgtttctgtgaggtaatcccacacatcaggcatgcgcctcagatgaattaatattcatcctctttgaagccgaaatcacgcagctgagacattttattccgccagtccttctgcactttcacccataattcgaggtaaacgcgtgaacccagcagcgcttcaatatcagcccgcgctcttttgccgacttctttcagaagcgctccttttttcccgatgacgatccctttttgagaatcccgctcaaccacaatggtggcggcgacatggacggagccgttctcctgccctttaatggactcgatagcgacagcgatgctgtgcggcacttcttcccttgtcagatggagcaccttttccctgatcagttcagaaataatgaaccgctcgggatggtcagtcacctgatcgctcggatagaactgaggcccttccggtaaatacgcttcaatctgcgcgagaagggtttcgacgttgttcccttccaaagctgagatcggcacgatttctttaaacggatagcgcgtacggtactcatcaattaaaagaagcagctggtcggggtggatcttatcaattttgtttacgatcagaaagaccggcgtggacgtctgtccgagcttttcaatgataaactcgtcgccctttccgtacccttcttcggcgttaatcataaataacaccaagtcaacttctttcagcgtattctgcgccactttcatcataaaatcgccaagcttgtgcttcggtttgtgaatgcccggtgtatcaataaaaatggtctgcgacgtgccggttgtcagcaccccttggactttatttcttgtcgtctggggtttgtcgctcatgatggcgatcttttgaccgatgaccctgtttaaaaaggtagactttccgacgttcggtcttccgatgatagatacaaatcctgatttaaagctttcgttcgtcatgtaaatcctccgatgaaaatgcgcccggcaataattcttccgcagtcatttcttttatttgtccttgtaagttggtcagaataacaagcatatcctttgagcacagctcggaaattacttgtctgcaggctccgcacggcgaaaccggtcccggagtatccgcagccacggcgagcatcgcaaattccgtatccccctcggaaacagctttgaatatcgccgtgcgttcagcacagttgcacatgctgtatgccgcattttcaatgttgcagcctctgtacacttttccgtctttggtaagaagagcggctcccactctgaaatttgaatacggtacatacgctgtgtcccgtgcttttaatgcttctgcaatcaattcttgtctgttcatgtgtacttaattcctctcttacctttatcctgtatgataccgctgtcacttttattttacataattatgatcggtttttcacgcccatttttggcaatgtaaaataattgtaagaatcttctgctaacatatcttcggcaggaagatgagtaaaccaatgatacacgatatcacggcaaagacgcaaacggctccggcggccgcgtcctttgccgcttttgcgagcgggtgatactgatcggtaactaaatccacaacatgctctatcgccgtatttaaaagctccaaagcaagcatccctccgatcagcaccaaaacaacggcccattcggctgtgctcagcccggtgagaaaaccgcaaacgataacggcgcaggccgcggtaatatgaaattgaaaattccgctctgaccgcgccgttttccagattcccctccatgcatggacaaagctcttcaggaacctgctccactcatttttatgatctcgtgagtccatactcatccagcaaatccttttgctttgaaaacatttcttcctcttcttcttttgtcatgtgatcatagccaagcaaatgcaaaaagccgtgcacggccagaaaaccgagctctctcataaacgaatggccgtactcttccgcctgctctttcgttctgtctgcgctgatgataatatctcctaaaacaggcggcatgtcggcgcctacgatttcaacctcgtcttcgccttcttcttcaagcgcaaatgaaatgacgtcagtcggggtgtcttttccccggtagtctctgttgatttctctgatttcttcatttgtcacaatcgtgaccgatacttcagcctgatcctgaacgccttctttttccgccgcgaattggagcagcttctccacttcttggagcgcatcagctgagacgctgttcgtttcatcaacaatatctatgagtaaacccatttatttcaccttcttcgtagcctccggatattcaatccgggagtggaaaattccttttaaagtcgcacatagtgtttttgcgatcgtatccagttctcggaacgtgagatcacattctgagaattgtccgtcctgaagcttatcggatataattccccgcaccagtttttcgatccgctcaggattgggattatgcatggaacggacggcggcttcaacgctgtcggccactgagataatagccgcttctttcgattgcggcttcggccccgggtagcggaactctttctctgtaatctggtcgcccttttctttcgctttataataaaagaattttaaaagggacgttccgtgatgctgttccgcgatatccacaagctctttcggaaacttatagcttctgagcatattcgcaccgtctgtcgtatgtgcgataatgatatttttgctgagctgcggagacagcttgtcatgcggattatccatattcatctgattttcaataaaatattgcggacgtttcgttttgccgagatcgtgataatacgctccgacccgtgccaaaagaccgtttgcccctacggcttcacaagccgcttccgacagatttgccaccatgacgctgtgatgatatgtaccgggtgtttccgttaaaatctttcgaagcaggggatgattcggattagacagttcaatcagcctcatcgttgaaagaatgccgaatcccgtctcaaaaaacggcatcagaccgataattaaaacggatgaagcaagtcccgagacgacccccatcagcatcagcgttccgatttcaaccggtgacagcgccgtattttgtattaataaaagcgacagcacgataatcatattaataaatgagacgaacagtcccgcctgcaatatttttgatctcgcattgtgtttccccaaaaacagaatgcctgaaatgctgctgattaaatagtaaatgccgatgacgtaattaaatgttcccgtcacaccctgattaaacatcatactgccgcagatcgccagaatgatgcttcctaaaatggcgagcctttcattgagcagcagcctgattaaaatcgcgccggcggcgatcggcacaagatagccgatattggtgtattcaatcttctgaaagagactgacgacttccataatgacgagaataagcgttgtaatgatagaaaacagcaaaagagatttatttttcagcttaagctcctgctgctgtttctcaaaatagtagacaagcgtggcaataaacagcccgatcatcagaagcagaccgctgatcggttttaacaggttggaattattcaaaagccccgtcagttcaagcttcctgtatacttcccggtcgatcagatcattctcttccacgagaacctgtccctgtttgatctgtaccggctggacgctgtctgacgcttcctggcgtttttcatccgtcgctttcggatcaaatacgtaattcgggatgaccgcgtattttccgatttcagtcgcagccgctaaatattttgacggcacagaagcgcttttcagctcttttgcgaccttatccttcgcttcggcaagcttttcagaaggaatttcactgctcatcaccgtattcaccgcggtaatgacggaatccctcacaaatgagaaatcttcattgtttgcatggagaagcgatttaatggcatcttccgagacggattcattgacatcctgtgtcagcttgtttttcaccgatttgaccagtgatttttccgatggtgactttttgtctttttccgcatcttttttcacttcgccgatgctgtcaaaaatggaagtgatcaggtcaagccggttgtcggtatagccttttttcagggtgtattgatcttccaccgcatcttcggccgcctgttttttcgattccgtcgcctgctgatcttccactgtggcgggcgcgtaaatcgtcttatcactgactgaaaacaaatccaaattaagtgattcaggttttacatgaataaagagcaaaccaaacatgatcgctgaaagcagcaggtacagcagcacatgggctgagcgggcatgtctgaaactgcggaaccgttcccgggcgcttttgcccttttccttctttttcaaaacaagaacctcctccctgaaacatcaggaacacatcatataaaaatgacccgataacgggagatcgggtcatttttgcattacttttgcttatcataagcttcaataatttttgcaacaagcggatgcctgaccacatctgtctggtcaagttcaatcacggagatgccgtttatatccttcagcatatccttcgctactgcaagtcccgatgtgacgcctttcggcaggtcaatttggcttacgtcgcccgtaatgatcattttagagccaaaacccaatctcgtcaaaaacattttcatttgagcgggagtggtattctgggcttcatcaagaatcacatacgcgtcgtcaagcgtccgccctctcatataggcaagcggggcaatttcgataacccctctttccataagacgctccgtatggtcgcttccgagcacatcatggagcgcgtcatacagcgggcgcagataaggatctactttttcctttaaatctccgggcagaaaaccgaggctctcgccggcttccacagcgggtcttgttaaaatgatttttttaatgtggccgttttttaaagcatgcaccgcttttacgaccgccaaataagttttgccggttcccgccggcccgatgccgaacaccatgtcgtttttcttcatcgccgccacatattctctttggccgagggttttgacacggatcggtttgccttttgccgttttcgttatttcctcttcatacatgctttcaaaatagtccagttcatctttttttgccattttcacggcatacagcacatcacgttccgaaatctcgatccccttgcgaattaaagtaaggagcgagcctaataatctgtcagcgatctcaaatgtttcatcattcccggaaacgtaaatggtttcaccgcgtgtgatgaggctaatgcccagatccttctccattaaatgtaaaaaggcatcttggctgccgaacaaagaaagtgcttcgtccgggcttttcagtttgtgattaatcgcaagtaaatgttctgccattctttagtctccctgaacaataggtgtggtttgaacgatatcttctataacttggtagagaataatcaactttactttaccattctcaacggattggtgcaaaactttttcactttccacctctccgctgccgtttaatcgcttttctacatcttgtcttcccattttgataccggcctgaaccgcttcgcctttcgtataagtccgcacggttgtttcactttctcttgtctgttcttgaacgtaagacaccggaagcttcatccccagaaattgaaacgggtgcttttcttcctctgttttcggatgtttcagcggctcctcattaaattcaaagccccaaaaaggcacgccccatgatccgaaagacagcttgtgcttcgtccttactttacccgtatatagcgtaaatgatgtttcaagaggcacggttacttctgacttgtaccatgtttctccgtaaatttccgcttttgaggcgactttccggtcttcatttccgatcagtcctgagacgagaagctgtcctttgttaacatgatcgttcacaaaagccatcggctgccccttttgcacgaacatccttttgatgaccgccttctttttggcaacgatatggcgggggctcacgtacttttcttttgtcggttcgtttttttcgaccactttcatatgaagggctgtcccgttcaattccacaccgacccacgtaatattatcaatgccgtttgttaatgatttttggattttctccggcgtcatcattaaaaattgcaaacggccttttttcacaccgatttcttcaaggtgctttaccatctgatgctcggtttcgggcttggcccctttaatatcaatgtcccaaatcatgttggacaaaagaaacaatataatgaaaaacatcacaaatcccgcagtgaagcccaggtttaattttgatttgagaagcagaaagggaagaccctttctttttgtaaagcttgctttgcattcatgttttctgatgactcttctgaaagcatgtacatcttgaagctgaatcatcagcagaacacagtcttgcttttttttcaccgcaaagatggcgattccgtttctcgtgcattcattcagcagccgttcaatcccttttcctttgacttccatttggactttacccgaaaaaaatgacagccatttgtttttcacattatttccccccggctttatgaatcgacatatcgtacgtgatctatcgtgccttccaaaaggatttcctcaggaaggattgccttaatgaccaagttttttcctgatatgatacattgcccctgcttgagcatcagcctgacttcttcttcgctgaacagcaggaggcctctgtgattctctatgtagatatgaagtctgccgaccatcgtaatacgaggcagatccatcataacgtccgggggaatttccaatgctcttgtcagccatgcctttacacgattctttctttgccccataaaaaaagaaccccctttcatctcatatgtatgatttgaaaaggggttctaacactttattttttaccgatgttccgcatggtccgatgcggtttttttgcacggggcggacccaaaacctcactgaatatgatgccttggaccgcagtttctttatttattttgagggctgatttcttcagagatgcgtttcgtgcgcgttgagaagtcagcttatgttcaagcccgttaaacatctgctccgtctccgctaggcgcttttcagcttcccttcttttttgctcaaaagggttctcttctgaaacggcaggcaattcttccgcttccggcttatgctctttctgcggctgtttttgatcctgcttttttgcctgattttcgggacgtgtacccggcggccgtttttcatctttgtttttcttgccgaatattgccgatataatgccgatgacggcggcaatgacgagcggatttgtcagaatctcgtgcatacagcggctccctccttaatagagaggttattgttggtcttcatcttgctggtcattcgtcagcttgccgatagaatccctcatgtccgtatccgcgtcgatattttttatgttcatatagtccatgacgccgatgtttccttcacgcagcgcttctgccatcgcaagcggcacttcggcttctgcttccacgacttttgcacgcatttcttctacgcgagcgcgcatttcctgctcttgggcgaccgccatggcacggcgctcttcggctttggcctgcgcaatgtttttgtctgcttctgcctgatccgtttgaagaatcgctccgatgtttttgccgatatcaacgtcggcgatgtcaatcgaaagaatttcaaaggcggtgcctgaatccagccctttgccaagtacggtctgcgaaatcatatcagggttttccagcacttttttatgattacccgaggaaccgattgtcgagacaatcccttctccgacacgggcgacaaccgtctcttctcccgctcctccgacaaggcgctcgatattggctcttacggtgattctggcttttgcttttacttcaattccgtccatggcgacacccgcgataaacggtgtttcaatgaccttcggattgacgctcatctgtacggcttccaatacgtcacgcccggccaggtcaatggctgcgcagcgttcaaatgtcagctcaatattggcgcgctgtgccgcaatcagggcattgaccaccctgtcgacattaccaccggccagataatggctttcgagctgatttgttgttgcggataggccggctttgtgcgctttaattaacggattgacaacgcggcttggtatgacgcgccgcagcctcattccgaccaaagtaaaaatgctgattctgactcctgccgcaagcgccgaaatccatagcatcaccggtacaaaggtgaagaatatggctaacacgattatggcagctgcaactattgctaaaatcgccaaacttgacagttccatctaattcctcctcaaggttatcatctatatttctctcacgacaatgcgtgagccttccgctttcactactttcacctgtctgtctttttcagtgaatgatccttccgagacgacatccagacgttcatcatcaataatgacggtgcctgacggtctgagggctgtagcggtaatgccgactttccccaacagctccgtccgattctgatttgaaacataaccgctctccgtgcttgttgaatcagttaatattaattttttaaagaatttcattcgtttccccaacacccttgttaatatgataaaggctgtaatagacacagcaatggcgatcaagagagaaaccgccattacggtaaagctgcccgcagcgagaaagaggctcgcgatgacgcctgcaataccgataagaccgattatgcctccgggcagaaatatctctaaaaggataaaaaccaagcccgcgcaaaataagaatacgctgtcatagccggcgaatccggcagcgatatgcccggtgaaaaacagcagcatggccgtcagtccgacggcacccggtatcccgaggcccggcgagaacaattcaatggtcaaaccaagcaaagcaagcgttaataagacggggacaacaaacggatttgtcagccatctgcccagtttgccgacgaaaccttcttttgcatggtgaacatccgctttgtcaaaacctagctttgtatataaagcatcaaggtctgaaaccgtgccctccgaatatccgacttccttggctttttcagctgtcagtgtcagcagttttccctttggggcgcccgcttcctttgcattgatggcgggatctgccatggccagggcgtatttcggatttcggttgtttttaaccgctgcgtcctccatttctgcatgccacagtgattgagcctttttgtccgccgcatttccttttccgtcgatgatggctgcggcacccatttttccgcccggcgccatatagatttcatctgcctgaagcgctatatacgctccggcagaaagcgcccgtttattaacgtaagcggtaacaggcacatccgcgcggccgatgatatccgcaatatccaaggctgattgaacggcgcctcccggtgtattgatgtcaagaataatgtgtgacgcgccggactccttcgcttctttgaaagaacgcgataaaaacgaggcgagcccctgttcgacatttttctcaaccgggatgacataaaccgatgggtgatcagctttcgcgttcaattgaacccctaataaagataatacaaataagcccaatagagcaacagcaattccgtttttttttcggaacaaggcaaatataccctccttcccgtttcgttcttctttatatacgtaacaaatgtactttagtttcatttttttatgtataaaaaaagacatctctctaggaaagatgtcttttttctcgtcaattaagataattgactgctgacaagtctgttaattacgctgccgtcagctttaccttttactttaggcataatagcactcatcactttgcccatgtccgctttggagctcgcaccgacttcagcgatggtttcatttacaattgtctgcagctcttcttcagaaagctgcttcggtaaataaatttctaaaatgtccagctctttttgaactttatctactaaatctaaacgatcagcgtttgaaaattcatggagggagtctttacgttgcttaagttcacgagataggacagtaagttcctcatcctcggtcaaactgtctttcttaagcttaattgcttcgttttgaagtgaagctttcaccattcgaacgacagtcagtttgtctttctcacggcttttcatatacagcttcatatcttggttaagtcgctcaagaagactcataaatccaccctcttttagaatttgcgttttctagcagcttctgactttttcttgcgctttacgctaggtttttcataaaattcgcgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaaaaagatacatatataaacatgtactttgacattataatataagccatcagtcaggtcaactaagcgagctcacttttccgtcatgaataaggctgcttgtctatataatgatggaaaggggtgtttcgtttgataatactgattctctttaccgcacttatcctgttttttttactcggaatgagcctgctcaggcagggcctgatcgcattaacgtattcaaaaattgagaaaagcctgctcttatttaccgaccaccctttgaaagcttttctcataagcatcgtattcaccggttttcttcagagcagctcagccttcatggtcattgtcatcggctttgtcagcgcaggcgctttatcttttaaacggaccattccgatgattctcggcacgaatgtcggctccacatttacgacggagtttttagccataaagatggatgtgctcatttgggtgctttttatcggaggccttgtgtttatcctcatccgtaaatatccgttcaggcagatcggtataagcttcctcggtctcggcatcatctttttttgcatcacatgcttcagccggcttgccgttccgctgacagaaatgaaggcgggggcggaggttttgcgccatgtgaatgattcgagctggtccgctctttttatcggcatgatattgacggcaatcattcattcaagctccgtctgcatcggcattttgatgagttttatgaacgaaggggtgatcggcattgaacaagcggtcagcgtcattctgggatctaatatcgggacatgcgtcacggccgtcatggctgctgtttcaggcggttatgccgccagacagaccgccggtgctcacgtagtgtttaatattctcggcgtgctgctcgtctttcccttcctgtctgcatcagcaggtattacggagcgcctgtctgatgatcccgcgcagatgattgcgcatttcagcctgttatttaacgtagtcaccgcgttattgtttctgccgttcacacatttgttttaccggctgattgacaggctgattcctccgaaaccgtaaaaaaaccgatgcgggaaggcaccggtttttttatctgttatgaagacatgcgcatgttccgggtcatttcaccctcaacgacgcggacgaattgtccttcgttatacggatagcccgctttttgaattttgactttaacaagtttgccgattacatcttccgtgcctttgaagacgactttcatgtaattgtccgtatagccgacgaacatgccgtcctcatcagactctttaaatgcctcttccggaatgatttccagaacctctccttcataatcggaggcgtattctttggcaagctggtcagacagcgcaatcagcttatgcacccgttcgtttttcacgttctcgtcaacctggtcttccattctggccgcaggtgttccggtacgtttgctgtaagggaatacgtgaagctctgaaaacttatgttctttaatgaaccggtatgtttccataaattcttcttccgtttcacccgggaaaccgacgatgacatcagatgtgacggcaagacccggcagcgcttctttcagcttatttaaacggtccgcgaaaaattccatcgtatatttgcgtctcatccgtttcagaacggtgtttgatcctgactgaatcgggatatgaaggtggcggacgattttatcagacgcgtccagcacttcaatcacttcatcagtgatttggcttgcttcaatagatgaaattctgatccgcttcagtccttctacacgtgtatcaagctcgcggagaagcttggcgaaattataatctttcatatcttcgccgtagccgcccgtatgaatccccgtcaggacgatttctttatagccggcatccaccagctgctgcgcctgtttaatgacttcttccggatcgcgggaacgaagcaggccgcgcgcccaagggataatgcagaacgtacagaagttattgcagccctcttggatttttaacgacgctcttgtgcggtcagtaaaagcgggaacatccagctcttcaaacacgcgtgctttcataatattgccgacgccgttgatcggctgacgctcttccctgtactgctcaatgtaaccgagcattttttcacgatcctgcgtgccgacgacgatgtcaacacccgggatggccataatttctgccggagaggtttgcgcatagcaccctgttacgcagatgacgccgtcaggattttggcggatcgcccgtctgatgacttgacggctttttttatctcccgtgtttgttaccgtacatgtattaatgacatatacatctgctgtctgttcgaattcttttcgttcataacccgcatctttaaacagctgccagattgcttctgtttcataatgattgaccttgcagccaagggtatgaaaagcaacagttgccattactgatcacctcttaataactctgtatgataggaaactgcgcttaacgcgtaaagaggcgcagtttcagtccgtaaaattctcggtccgaggccgcataagacggcgcctttttctgaaagctgatgaacttcagactcagtcagaccgccttcagggccgaatacgattaaaagagacgaaccttgcggaaggcttttaagctccgcggcgaaagcgcccgtttctccctgctttgatgactcctcgtatgcaacgacacatttatcgacattctccgccatttcaagcagctgccggaacgtatgaacggttttcacttcgggaatttcattgcggtacgattgctccgccgcttccttcgcgattttcgcccatctctcccgctttttctttgcctttttgtcgtctagcttaacgacggatctggcgccttgaaaggggatgaacatactagcccccagctcggtccctttttggataatccattcaagcttatcgcctttcggaaggccgctggcaatcctgatcttcaaaggcagttcacggttttcacccgtccattcagcaatgctgcatgatatatgatctttagaaaccgctttgagcaggcataacgcttcatggccgtctttcgaacagcagataatccggtctcccgcactcattctcatgacgttcgctatatggtggacgtcttcccccgtaatttgaaaatcgggagtttcgtccatctcctgcttcgtgagctcgataaaatatcgttgcatacgctgtgacacctactaactgttattttttcgcgatgatgctgacccaatcttccatagacagaatctctgtgatggtaaagccggctttttccaacgcttcttttacttcctgttttttctggccgataatgcctgaagtaataaaatggcctccgtctttgagcaggtcgtacgcctgtgatgtaaagcggagaatcacttctgccaaaatatttgcgacaatgacatcatgttcgcccgtgatgccgtctaacaaattgttctgcttcacttcggccgtatcactcactttgttcaattttagattcagacgcgcgctttcaacagcgaccggatcaaggtcatatgcatgaaccgattcggcctcaagcatggcggccgcgatgcttaaaattcctgaaccggtgccgacatcaatgacacggtcgcctttttgaacgatacgctcaagcgcctgaatgcacagaacggttgtcggatgcgttcccgtaccgaatgccatgcccggatccatttcgataatcagttcatcggtattcacgggtgtgtacgtttcccatgtgggcacgatcgtgaatttttcagaaattttcaccggatgataatactttttccaagctgtcgcccattcttcttcattaacttcagaaatggtgattgtgtttctgcctaaatcaatgtcgtacaaaagcagattattaatcgtctctttaatgccgtccaccgtttcgccgaggaaactgttaatcggcagatacgctttgacaatgacaccctcatcggggtaatcattggggtcgagctggtagatttccccgtaaacattctcacgctctttcattaaatcaagcggatcttcgatgacaaccccgctcgcaccagcttcatgcaaaatatttgagatgggttcgaccgcttcatgtgttgtgtgaatgctgatttcggaccatttcaaaactaccaactcctatccaatcattactcgcctttaaatgcgcgttttactttgtcaaagaaactcatttcttgttcatccggcaggtttccgctgacttcagcgaactcgcggatgatgtctttttgtttgtctgtcagattcgtcggtgtgacgacgcggacgacaatgtgctggtcgccttgtccgtagccccggacgttctgaacgcctttgcctcttaatctgaatttcgtgcctgtttgtgtgccggcaggtattttcaatttcacttttccgtgaagcgtcggcacttccacttcgtctccgagtgctgcttgggcaaacgttaacggcatttcgcaataaatatcgtctccgtcgcgttcaaagaactcgtgggcgcgcacatggaatacgacaaacagatctcccgcaggccctccgtttacgccaggttcaccttggcccggaacgcgcagctgctgtccgtcatccacaccggcaggaatcgtgacattgatttttttccgttttttcactttgcccgtgccgccgcagtcagaacacttgtttttgatgatttttcctgttccttcacagtggtggcagactcttcggttaaccactttgccaaacggcgtgttctgttcgacgttcagctggcctgaacctccgcagtgcgagcacgtatccggctttgttcccggcttcgcgcccgatcctttacatgtttcgcaattctcttcgcgcggaatttcaatgatcgtttcttttccgaaagccgcgtcttcaaatgacagggtcattgtatactgcagatccgcgccttgccgcggcgcattcgggtcacggcgtctcgtgccgcctccgaagatgcttgagaatatgtcatcgaaaccgaagccgccgaagtctccgccgcctccgaaaccgccgccgaatccctggttagggtctgtatggccgaattggtcatattgagcgcgtttttggtcgtctgagagcgcttcgtacgcttcttttacctctttgaatttttcatctgctccggattctttattgatatcaggatgatatttttttgaaagcttccgataggcttttttgatttcatcctttgaagcgctcttacttaccccaagcacttcatagtaatcacgcttactcatctcgcttcactctcccgaatttctcacataaattagattgtatcattttgaattatgttttttcaattccttttatcccgggcaagaaaaaaagtcaaagccaagagatgcctgactttgactttctgtctgttgaatcagaatatgctgggtgttcttccgcctaaagccatgcgggaaagaacttattttttcgtttcgtcgtcttttacttcttcgtattccgcatcgacaacgttgtcatccgcttttttgccttcagcgtttgctgcgccttcagcctgctgcgcttttgccgcttcttcataaagcttcatagaaagctcttgaacgattgtttgaagctcatcttttttcgctttgatgtcttcaatttcgtttttctcgatagcggctttcagcgcgtctttcgcgtcgtttgcttttttcacttgctcttcgtccactttgccttccagatcttttaatgttttttccgtttggaacacaagctggtcagcttcgttgcggacttcgatttcttcttttctcttcgcatcagcgtcagcgttttcttccgcttcttttaccatgcgttcgatctcatcatcagaaagacctgaagaagatttgattgtaatgttttgttcttttcctgtgcctaagtctttcgctcttacgtttacgataccgtttttgtcaatatcgaaagaaacttcgatttgcggtacgccgcgcggtgcaggcgggatatcagtaagctggaagcggccgagcgttttgttgtcggcagacatcgggcgctcaccttgaagcacgtgaatgtcaacagccgtttggttgtcagctgcagttgagaatacttgagacttgctcgtcggaattgtcgtgttgcggtcgatcagtttcgtgaacacgccgcccattgtttcaataccgagagaaagcggtgtaacgtcaagaagaacaacgtcttttacgtctcccgtgatgacgccgccttgaatcgctgcacccaacgctacaacttcatcagggtttacgcctttatgcgcttctttacccgtttcttttttaattgcttcctgtacggcaggaatacgtgttgatccgccgacaaggataactttgtcgatttcgctcgcagaaagatccgcatcttgaagagcctgacggacaggagccattgtgcgctcaacaaggtgagcggaaagctcttcgaatttagcgcgggtcagtgtcagctcaaggtgaagaggacctgcttctcccgctgtgataaacggtaaagaaatttgtgtagatgatacgccggaaagatcttttttcgctttctcagccgcatctttcaaacgctgaagcgccattttgtcttttgaaagatcaatgccgttttcttttttgaattctgctacgagatgatcgatgatgacttggtcaaagtcgtccccgccaagacggttgtcaccggcagttgaacggacttcaaacacgccgtcgccaagttcaagaacagatacgtcaaacgtaccgccgccaaggtcgtaaacaagaatcgtttggtcttcgtccgttttatcaagtccgtatgcaagcgctgctgcagtcggctcgttgataatacgctctacctcaagaccggcgattttaccggcatcttttgtcgcttggcgctctgcatcgttgaagtatgcaggaaccgtgataacggcttttgaaactgtttcgccgaggtagctttcagcgtatgctttcagatgctgaaggataatagctgatacttcttgaggcgtgtagtcttttccttcgatttccactttatagtcagtacccatatggcgtttaacagacatgattgtgttaggatttgtgattgattggcgtttcgccacttcccctacttggcgctcgccgtttttaaatgcaacgactgacggagtcgtacggtttccttcagcgttggcgattactgtaggctctccgccttcaagcactgccacacatgagtttgtcgtacccaagtcaattccgattactttactcactttgaattacctcctgctatgtagttattgattcacttttaccattgaaggacggatgacgcgatccttcagtttgtagcctttttgcagttcttcgataacaatattgctgccgaagttttcatcttccacctgcatgacggcttggtgaaggttcggatcaaattcctgaccgacagcttcgatggcttcaacgccttctttttcaagtgcgtccatcagctgacggcggaccatttccataccttgcagcaagctttttgtctgctcgctttcagcttctacctgtaacgcccgttcaaagttgtcgagagccggaaggatttccgttacgacgttttgagaacggtatttctgagcagcttccatttcaaggcggctgcgtcgtttatagttttcaaagtctgcttgaacacgcaaaagcttgttttctttttcatcaagcaaaccctgcaattcatcaatttggtgctgaagggcttcttcctgacctgccgtttcttcatgctgctcttgtgaagccgcttgttctgcctgttctgtcacttcttcttgttctgctgcttcaacctgttctgcggtttgtttttcttctgacattgtgttcacctccctcaaatgctgtaaaaagatgactgaaaatgattgccaaaattcccttattcatcatacaaacttgtgaatgcttttgacaagtccgaagtcacgtgctgcagcaggctgacgactcttgaataattcatgcgcgtcggcccgataatcgcgattgatccgatctgcttcgtatcaactgtataggtggccgtgattaagctgcagttttccatttcttcgtagtcgttttctttcccgattttgattgaaattccggcttttgatgactgaaacagcttcagaacatcctgctctttttcaattaaagataagagcgagcggaccctttcaatatcgtggaactccggctgattcagcatgttgatctttccgccgaaaaacaatttctcaacgtgggccgccggatggaatgtggagcggagcgattcaagtatgctgtcatagttggcgatatgctgccttaaatatgtgacaacctctttgaaaatgcgctcattcaattcgtccatcggcacgcccgctaatcgatcgtttaatatattgaccagtttttcaatatcggccaaatccactttagccgggaaattgatggtgcggttttcgacatgccccgtgttcgtgacgaggatggcgaccgccttatccggctggatcggaacgatttgaatctgtttaagatagttctcgctcagcgtcggcccgaggacaatcgatgtgtagtttgtcagatcggacaggatttgcgctgatttttggactgttttttccagctcgaagattttttctttaaatatcgagtgaattaaatccagatcggtttttgtcagcttgacgggtgacagcaaatgatcgacataatacctgtaccctttttccgacggaatccgtcctgaggatgaatgggttttttcaataaagcccaattcctccaagtcagccatctcgtttctgatcgttgcagagctgaatgtaatctcgtctttttttgaaagagttcttgatcctacaggctgcgctgattgtataaaatcattaataatcacttgcaggatcaacagctgacgatttgttaacatcatcatcacccctgttagcactcaaggtcagcgagtgctaattctatatcaaaagtaacaaaccaaaagaaaaatgtcaattataactcacccaaaaaagcgccaaaaacctcatttcctaataatttgccctcatgcgttaatgcaaccgattcttccgtgtcacagatcaggcctttttcggttaaatctttgagaacatcgggaaacagttcgtcaaccgagcgtccgaatttatcgagaaaagcttgcttttgtacgccggacatttttctgagaccgaggaacatttcttcttcaatctgctcctcccgtgtcacctcgtgcgtatcacggtaaggcagccccttttcttcgatgagctgaatataatgtttcacaggcccggcgttgacggtgcgcgtgccgctgatatatccgtgagcgcctgcgccaaaaccgaaatacgcttcattgctccaatacgtcagattatgctgtgactcgtatccgggctttgcaaagttactgatctcgtattgacggatgcccgcttcactcatctgcctcatgaccgtttcatacatctcggcctcttgttcttgcgccgggagatgcagacggcctttttgcattaaattataaaacaccgttttcggctctacgatcagcgagtaaacggaataatgctccgcatcaagagacaaagccgttttgacggaattgtcaaggtcggccagcgtctgacccggcaggccgaacatcaaatcgagactgatgttgtcgaagccgagagccctcgctcgttcaaaggaagtgaatacgtccttttgtttatgcactctcccgattttttgtaaaagctcatcttcaaaggtttgaacaccgaaactcagccgattgacaccggcatttttcatgatttttaatttttccggggacaaatcatccggattcgcttccgcggcaaattctatgagtccgtcagaaggtttcagcacgcggtgaatggaatccatcaatttttccagctgggcgggtgagagcgatgtcggcgtgcctcccccgataaaaatcgtgcggagatcagggcgtcccgtccgttctattgtatttatcatttccttttcgagtgagtttaagtactcatcgacaggctggctctgaataaaatatttattgaaatcgcaatagtggcagatatgctcacaaaacggaatatgaatataagctgatttcattttgaaacaccttcttctttacagaaagaagccgcagcgcgggactgcggcggcttccgttattttttcgggctgtcatccattttaagaacggccataaacgcttcctgcggcacttctaccgagccgacctgcttcatccggcgttttccttctttttgtttttcaagaagcttccgtttccgcgagatgtctcctccgtaacattttgcaaggacgtttttccgcatggccttaatggttgagcgggccacgattttctgtccgatcgctgcctgcacgggcacttcgaattgctggcgggggatcaattctttcaatttttcgacgatgactttcccgcgctcgtatgcgtaatcgcggtgcacgataaacgacagcgcatcaattttttctgcattcagcataatgtccattttgacgagtttggacggtttgtagccgatcagctcgtaatcgaaagaggcgtaccctttcgtgctggatttcagctgatcaaaaaattcatatacgatttccgcaagaggcatctcatatacaatgctgacccggttggcgtctaagtactgcatatcgataaagttgccccgtttcccctggcaaagctccataaccgctccgacgtaatcgttcggaaccatcatcgtcgctttgacataaggttcttccacccgctctattttttgcgggtcaggcatgtttgacgggttatccacgatgatcttttcgccgtccgtcatataaacgtcataaataacgctcggcgcggtcgtaataaggtcaattttaaattcccgttcaatccgctcttgaatgatttccatgtgaagcattcctaaaaaaccgcagcggaaaccgaagccgagggcttgtgacgtctccgcctcgtattgaagagatgaatcgttcaattcaagtttttccagagcttcacgcaaatcattatatttggctgtgtcaatcggataaagtccgcagtataccatcggattgagtttgcggtagcccggaagcgcttctgccgcaggcttaaccgcgctcgtgatcgtatcaccgacacgggtgtcgccgacgtttttgattgcggctgtcaaatagcctacgtcaccgactgtcaattcgtcagccggctgcgctttcggcgtaaagacgccgacttcaatgacttcaaactcttttccggttgccatcattttaattttctggcccggtttgaccgttccttctacgactctgatatacgcgacgactccgcggtacgcgtcataaagcgagtcaaagatgagcgctttcagcggagcttccggatctcccgcgggagccggcactttttctacgatctgttctaaaatgtcttcgatgccgatgcccgctttcgctgaagcgaggacggcgtctgaagcgtcaaggccgataacgtcctcaacctcttgacgcacacgttctggctctgcgctcggaagatcgattttattaatgacaggaagaatctcaagatcattatcaagcgccagatagacgttcgccaatgtctgcgcttctattccctgagccgcatcaacaacgagaatcgcgccttcacaggcagccaggcttcgcgaaacttcatatgtaaagtcgacgtgtccgggcgtgtcgatgagatggaatatatattcttctccgtcttttgctttgtatttcagctgaacggaatttaatttgatggtaattccccgttcgcgttcaaggtccattgaatcaagcaattgttctttcatttcccgctgggtgatcgccgatgttttttctaaaatccgatccgccaaggtcgatttgccgtggtctatatgggcgatgatggagaaattccggattcttgactgcctctctaaacgcttttctttatctgtcacaatctatcactcctactattaaacgcaaaatacactagcttagattatatcaataggattgtaaacattcaattaaaacaagaaagagaaaagcttcctttaaggaatcatccgcttttctcttcatcaatgctatcggttcagtttcgaaacccactcgtacatcgcctgcgccgagtccgtcacggtatttgaaagggtttctcccgcttttgaaaacaggttgaaggtttccgcctgttccagctgtttttgtttttcttccagatctttcgccgtaacggtttgccccaaaatggaagcttctttttcctgtccttctccgccgccgagggtgaatgctccttttaaggagggatctttgtatcctttcatatcaagcattccgctgtttgcctgctgcatgccgaacaaaacgccgaaaaacatgacaatggcgatcagcaggcatttgccggtaaaacggatcattcgaatcacctgatttctattgttttttcttctctcctgattgcgagctgaccttgtctgcatcccagtacagttcgctgaacacatcggccacggcatctgatgcgcgcctcagttcttctagattgttatccacgcccccgaattccagcagaagcgaccggtcgtttaaatcctggttgtatactccattatctcccggagagccttttgataaaacaccgacgcttaagccggggtattttttctccatcagcttatgaagttcacttgcgagtttatagttttcttcaaaattagcgctttttttgccgaccacgatggcgactctggcatagctttttcctttgatgtcggctgtcgtatttttcttgcggcgggaatcccggtgaatgtctatggtatattgcaggtttttatttttggcgagcgcgctttttacgaccggccttgattcgtcatagcttcgcgcataatttaagccgtctttgttcaggcgggcctgaatgtcggttttatctacggtcgctcctacaccttgcgcttcaagcgcttttccgaacatatctccgacaagcgtgacattggccttcgaatggcgggcgttatccggatttgtttccccctttaacagaggaagataggattcggtattatgagtgtggtaaataaaaacgacttttttgctgcctgttgaatgtttcggcggcgccgtttcttcttttttcgttttgttttcgatttctgccaggttcacttctttttctttttccatcaccttcgacggcggcggagattcagcaggcatattcgtataatccgtcccctgccccgccagaaggatctccgtatcgtattgggcaaatcccggcagctcacgtcccaagaaactccgcgggtcttccatattaatacttgtcgccagttttaaggaaagccgggacagctgaaaagagtctttttcaggaagctctgaggcgaaataatgattttccataccgaggaggtgtgcaaacgcgtcacccggaagttctccggcaattccgtgaagagaatccgaagaaagcctcagttcagggcgaagcgatgtgagcacacccgataatacgaaaataacgataaggcttgtcataaacaaaaacatgcccttgagcgcatttccaccgtttactgcaacgacaatttgacggtttctgcgtttttttctcatgatttgaatccctccagcgcttgtctagtaattactctatgaacaagctagaggaggtagaaccattttaatgattataagagcctttgttatcttgtgacactttttcatgaagggcggtgtttaacccgtttgcaagcacgttcgccatatcatcaataaaggtgtcaatctccttcggcgtgaccatcagattatggccgagcggagagagcacttcgtgaatcagctggcgtttttcgttttcgtccagcgtgccgacaataccgagaaaggattggcgttctttttctccgggaaggtcttcgtctgtcagcaccttctttttgccgaagttcattccggcgggcaccagagatcttgacgggctgtcatctttcatctctctgccgaaatgctttaatatataatccaccgtatcgcttgcgatcgtaaccgcatcaacgacagtcggtaccccgattgcgatgacggggatgccgagcgtctccttgcttaattcttttctcttattgccgacgcctgatcccgggtgaatgcccgtatcagaaaattggatggtcgtgttcaccctttcaacggctcttgccgcaagagcgtctaccgcaatcacaaaatccggctttgattctttgatcacaccttgaataatatcgctcgtttcaattcccgttaatcccatcacaccgggagcaagcgcgctgaccggcctgtacccttcctgtacgttttccggctgaagcctgaacagatgccgtgtcacaagaaggttttcggtcacgagagggccgagcgcatccggcgtcacattccagttgccgagaccgacgatcaaacagcttgcatcctttggaatctttaatgccgacagataggcggaaaattcctcggcaaacacttccgttactttttcctgcatgtcagagtcgtgttcccgaaccccttgagcctcgatcgtgacatagcgtccctgctttttccccgatagctcggcgccttctttggtaatatcgacggttctgactttaatgccgcccttgtcgcgttctttttcaataaacccgtttatttcttttgtctgaccggcttgtccgtcttttaccgcctgtttcgtttctaccgctaaatccgtccgtatcagaaattgattgacattcagttcgttgtttttcacaggaaagacctccttcaatcatcgtggtacatagtgtggccatttacaaaacgaatcatgcgaatttacccatcaacgaaaaatactttacatttatattgcaatctaaagttctgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgctcataacgcgacaatcaaatctgctatgcgtactgcaatcaaacaagttgaagcttctgttgctaacaacgaagcggataaagcgaaaactgctctttctgaagcagcgaaacgcattgataaagcagtgaaaacaggtcttgtacacaaaaatgccgcagctcgatacaaatctagacttgcgaaacaagtgaacggactttctgcataatacaaaaacgatccctttaacggggatcgtttttttcattcagtccggagaagctcaaggagaaagagctccagcaagagctgcttgtcctttttccccgttttcatttcataatccatcactgcgagcctttctataatacgccgcagctcttcttcagaaaaaagcctcgcctgatccatcgccagctttacccggaaagggtgcacctttaagttggaagcgatttgcttttggccgtatccttgtcccgcaaaatactttgtctgcataatcagacggaattggttggcgatcagcgccataattttgatcggttcttcgttttgttttaaaagatcataaaatatttgaagactttccgtccgttttcggttcacgattttgttgatcagctcaaaaatattctgctccaaacttcttgcgacaagctcccggacatcttcaagcgtgatctcatgtctgtcaccggtgtaggcggagagtttttgtatttcctgatatatggaagacagatggccgtttgcaagcagaaccaaatgctcggcagcttctgtatccatcgttttattttcggatttcgccagattaatcgtaaaatcagtcgtctcctttgcattcagctccttagcttcaatcataagggctttttgcttcagcgctttcgtcagctttttccgttcgtccagcttttcatacggagccacaatcacaaagaccgtataaggcgcaggctccttcaggtaagtctccaaagcgcttgtattatgctctattttttctttctttttttctcctgttaaaaaagacggattttttacgataaccagccgcttctctcccataaacggaaacgtttccgcatcggttatggcctggtcaagcggatcctcttcaagatcaaaaacagacaggttaaaatctttagtctcctcatcaacgacagcttgtctgatccggctgacagtctcttggagcagatacgtttcttttccgtataagcaataaacggagcggacatccccttttttcagggctttccaaacatcaaataccatgatcgtatgacttcctctctttcttgatccccttctatcctaaattgagttcggcaaatagtaaagaggaagctttaaaaaggacagcttcctcatttataataaacgcctgattcacaagctcccgggtctgcttgtaaaaaggcgataatcacaagaacagaaaacgttaccatcacttctagatttttcaaaacaattccagtatacttagggaagtcaggagggatgaaattgaatgattttgaaaaaaacgttcaaagcaaacgaaatgatgctgttgactcagctgtcggttttgtcgtgtccttcggatttttcgcctttttgttcgtgatggcaacagccatccatcttatcggctcttagccgcattccgggctgctgtcaatcggcagtcttttttacttcttgcgccctggtttcttctatatcatatggagggaagacggaaaacgttccggcgcctttttcaaatctgtattgaatcgttccgctgatatcggtgcgaagcacattgacagagtacgccttcaaacgatccagcacttcttcatgcggatgatggtatcgattctcttttcctgctgaaatcagcgctgcttccggctgaagctgtttcaaaaaggcttcactcgttgagcttttgctgccgtgatgacccgccttcaatatatcagccttcagtttcggatacgttttcagcacttctgtttcgccgtccgattctaaatctcccgtcaaaagccagctcactccgcctaaaaccgtccaaagcaccagtgatgaatcatttttactctttccgtcagatgactccggagacagcacctgaaactgaagatcacccgctgtaatggtgtcgccccgctttgcttcggcaacgggaatgttgttttctttcgccatttttaatatgttctgatccttcggttcttttacgaatcccacggggacaattaaccgtttgactctatgatttttgattaacactccggcttctccgatgtgatcctgatccgcatgggttaaaaacagcgcatccagctttttcaccccttttccgtttaaaaacggaatcaaaaccttctcgccgatagaatacgggtggcgtttttctttccatgattctccgggataagcaatcactccccctgtatcaaccattacggtccctttgcggtatggcgcgcttataaacagcgagtctccctgcccgatatcaagcatatccgcttctccccatggactgaaatacggacggcatattaaataagccaaaaccgcgcagaaaaaaagagccgatttcctgagttttaaaaaacctcccttttccaaagccgcaaaaagcgtaaaaacggaaaccgcaagcagaagaagggaaagaaagtcaggctttgacacaatcatagtaaataaatcaacggatgccgcatatgtaatgaaatcatgcacaggcttcatcacaaggtcaaacatatcaaacaaacattctcccatctgccttgaaagcaaaagaagaaggaagccgatgacagaaaccggaatgacaaataacgtataaaatggcaccatcaccatgttcatcggaaaactgacaagtgaaatttgttgaaaatgatagagaagaaacggaagtgagctgagctctgcaatgaatgaggccatcgcaagcccggcaagtctgcttttccccgctttctttaaaatggaggatgacagaattaaagaggcgcttaccgcaaaggaaagctggaagcccgcctgccaaaggaagtaaggattaaacagcaggagcagcagataagacagagacaatgcagcagaggaatgaatgccgcgtttaacaagagttccggcgatataaaatcccagcatgagggatgcgcgcaatacggatggggcggcaccgctcagcagcgtatataccggcaaaaacagcagcagcaacatccccgccttttctcttgtcagcccgattctgatcagagcataaaatagtcccgccgtaataagaccgacatgcattcctgaaatcgccattaaatgaacgactcccagattttgatatgcactcagtatatcgtcctctatagaaaatctttcacctaaggtcagcgcttcaacaattccggcggaagattcaggcacgtgattccgaatgattgaaatcaaattttttctgatgttcagcagtttaaacagcggctgtttggatttttcacaccgctgaatggaagtcacggaaaataaccagtgaatctgctgagagtaaagatattccttataatcaaaacctccgggaatcgtcgcatgtgcaggctgttccagagagcctgtaaacgtgcagcgcatccccggttcaagctgttcaatgagtctcttttcctcaagagaccggattttatacgaagccgcccatttttccttgtcatgtgtacggataacggctgacattttcgctccgtcaaccttcggaatattagtgatgacggcctgttcagtataactgccggcctgatatcgcgttacattcgcagcgtcacaaaccgtataaagaaagaaataaacacaaaaagaaacgaggcagatgataaccggagcaggctgctttgtttttatcataataaagagaagatacagaagaaaaaggagcagaacccagaagacatgagcggcggcaattcccgcagttgcagaaaccgccgccagaggcagaagaaggtatttatatttcatttatacgtaactggtaaacagctcattggcctgttcatgaatttttttcagttcatctgccttaactcccgcatcagataattgctgaatcagacctgcgacaaaagacaatttttcgcgatttttgagatcgatgatcatttcatcaagttcgacctgctccaccttgactccggcttggctgaacagctcttttgcataaggctgtgttttgtaatcttcggcataatagaccgttttgatgcctgcctggataattgatttgcagcattgaatacaaggataatgcgtcacataaatttcggcgccctccgtcggaacaccgaacttagaacattgcagaatcgcattcatctctgcatgtatggtcctctggcaatgattatctattaaaaggcatccttcatcagcgcaa

(The sequence listing continues in the following parts.)

What is claimed is:

1. A composition comprising *Bacillus subtilis* 281, *Bacillus subtilis* 3, *Bacillus amyloliquefaciens* 298, wherein the composition does not comprise more than 5 different species of microbes, wherein:
   a sample of *Bacillus subtilis* 281, has been deposited as KCTC 13468BP at the Korean Collection for Type Cultures;
   a sample of *Bacillus subtilis* 3, has been deposited as KCTC 13467BP at the Korean Collection for Type Cultures; and
   a sample of *Bacillus amyloliquefaciens* 298, has been deposited as KCTC 13469BP at the Korean Collection for Type Cultures.

2. The composition of claim 1, wherein said bacterial strain is attached to a solid support.

3. The composition of claim 1, wherein said bacterial strain is soluble.

4. The composition of claim 1, wherein said *Bacillus subtilis* 281, *Bacillus subtilis* 3 and *Bacillus amyloliquefaciens* 298 are present in a ratio of about 1:1:1.

* * * * *